United States Patent 7,745,391 (HUMAN THROMBOSPONDIN POLYPEPTIDE) - sequence listing, part 13

SEQ ID NO: 31143 - DNA, 1984 bp, Homo sapiens
agcggagtcggagccgggcttgcccgggcatgtgggagctgccggctttccggacgccacgtgcagaccggaagagacacgcggggcttcaggctgctgccccattggaagattactccccaggcttcccttgccccaagcagtgagctgactggaatggtaccccgggaggcccctgagtctgctcagtgcctgtgcccttccctcaccatcccaaatgccaaggatgtgcttcggaagaggcacaagagaaggagccgacagcaccagcggttcatggcccggaaggccttgctgcaggagcaggggctgctgagcatgcctccagaaccagggtcctccccactgcccacccctttcggggcagcgacagcaactgaagctgccagcagtgggaagcagtgtctgagggctggatctggcagtgccccatgcagcagaaggcctgctcccgggaaagcctcagggcccttgcccagcaagtgtgtggctatcgactgtgagatggtgggcacgggaccccgagggcgggtaagcgagctggcccgctgttccattgtgagctaccatggcgatgtcctctatgacaagtacatcaggcctgagatgcccatcgctgactaccgtacccgctggagtggcatcactcggcagcacatgcgcaaggctgtccccttccaggtggcccagaaagagatccttaagctcctgaagggcaaggtggtggtggggcacgcgctgcacaacgacttccaggcgctcaagtatgtccaccctcggagccagacccgggataccaccgtactgggctcttaagcaaaagtctgagaaacaagacagtggtttgaattctggggcctttgtgtaggattgtgcctgacctttatttatttattaacagcagggccactcgtctagggcagtggagtctgcgtgtctcctggggctggggcagggcattggcagttacgcagtggccctgaacctggtctggtgcccccgaacctggtctgatgccccctcagctctttgacaatcactgtggctgttgggttttctcctatttctaaaaatgttctcttctttcctaagtgacagttttgaagtattggataaccaagagctcaggtcacacagaccttggagccccatctttgcttgcagcttagctttgagatactaagcaagcgagggacttcactcttgagcctgttttttcctcatctgtaaagtggggatagtggtacggcctacctcatagggttgtaatgagcactaaatgtgaagtgcttggcacagtgcctggcacatggtgagccacagctactgtgagtttctgtttatcccccttttttttttttaagcccattgtttattctttgagaatttgttgtaacttcttcaggataacacctgagtccacaggctgagcagctgtggcccagacagaactgctccggcttggctgttccagcaggtggggcgctggcctcggtgagggcacagcagcaaggttcacggatatccgtgtgtcttgtctgtggccaccaggcacaggtttggcttccggtcagtgtcccgacactgtgcgggaggtgacaacagagcaaagcagcgcaggggtcagggaggtggagacactgctgaaatcacactaccccaccctcagctgaagccccacgttccacaaacttggggtcatagattgtccagtcactggctccctccctgtcagcacagcacagaggaaggggctaactgaatcttttaccacttctggcctggctccagaactttgttctagattccttaaaagtcggtagctgatgtcaaactcaattgagcagtagctttgatcccttggtctgggggtcgaaggaagatggcgctgttatcagcggggaaatgtactatttaagatcagctttgttgtaaaaccatttgttctagaataaaactcaattggaaacgtgaaaaaaaaaac

SEQ ID NO: 31144 - DNA, 1367 bp, Homo sapiens
aaagttccctgtgagcagttgcaaggaagcccccacaggcttctcgtggggagttggctccttaacatttcttggcaacagaaagccccaggcacagctcagggaggagggaaggcaggtaagctttggacgagaactggcatatttattttgacccaaatcagggatttccccagtccacccagtactgggctcttaagcaaaagtctgagaaacaagacagtggtttgaattctggggcctttgtgtaggattgtgcctgacctttatttatttattaacagcagggccactcgtctagggcagtggagtctgcgtgtctcctggggctggggcagggcattggcagttacgcagtggccctgaacctggtctggtgcccccgaacctggtctgatgccccctcagctctttgacaatcactgtggctgttgggttttctcctatttctaaaaatgttctcttctttcctaagtgacagttttgaagtattggataaccaagagctcaggtcacacagaccttggagccccatctttgcttgcagcttagctttgagatactaagcaagcgagggacttcactcttgagcctgttttttcctcatctgtaaagtggggatagtggtacggcctacctcatagggttgtaatgagcactaaatgtgaagtgcttggcacagtgcctggcacatggtgagccacagctactgtgagtttctgtttatcccccttttttttttttaagcccattgtttattctttgagaatttgttgtaacttcttcaggataacacctgagtccacaggctgagcagctgtggcccagacagaactgctccggcttggctgttccagcaggtggggcgctggcctcggtgagggcacagcagcaaggttcacggatatccgtgtgtcttgtctgtggccaccaggcacaggtttggcttccggtcagtgtcccgacactgtgcgggaggtgacaacagagcaaagcagcgcaggggtcagggaggtggagacactgctgaaatcacactaccccaccctcagctgaagccccacgttccacaaacttggggtcatagattgtccagtcactggctccctccctgtcagcacagcacagaggaaggggctaactgaatcttttaccacttctggcctggctccagaactttgttctagattccttaaaagtcggtagctgatgtcaaactcaattgagcagtagctttgatcccttggtctgggggtcgaaggaagatggcgctgttatcagcggggaaatgtactatttaagatcagctttgttgtaaaaccatttgttctagaataaaactcaattggaaacgtgaaaaaaaaaac

SEQ ID NO: 31145 - DNA, 1655 bp, Homo sapiens
agcggagtcggagccgggcttgcccgggcatgtgggagctgccggctttccggacgccacgtgcagaccggaagagacacgcggggcttcaggctgctgccccattggaagattactccccaggcttcccttgccccaagcagtgagctgactggaatggtaccccgggaggcccctgagtctgctcagtgcctgtgcccttccctcaccatcccaaatgccaaggatgtgcttcggaagaggcacaagagaaggagccgacagcaccagcggttcatggcccggaaggccttgctgcaggagcaggggctgctgagcatgcctccagaaccagggtcctccccactgcccacccctttcggggcagcgacagcaactgaagctgccagcagtgggaagcagtgtctgagggctggatctggcagtgccccatgcagcagaaggcctgctcccgggaaagcctcagggcccttgcccagcaagtgtgtggctatcgactgtgagatggtgggcacgggaccccgagggcgggtaagcgagctggcccgctgttccattgtgagctaccatggcgatgtcctctatgacaagtacatcaggcctgagatgcccatcgctgactaccgtacccgctggagtggcatcactcggcagcacatgcgcaaggctgtccccttccaggtggcccagaaagagatccttaagctcctgaagggcaaggtggtggtggggcacgcgctgcacaacgacttccaggcgctcaagtatgtccaccctcggagccagacccgggataccacctatgtcccaaacttcctcagcgagcccggcctccacacccgggcccgggtctctctaaaggacctggccctgcagctgctgcacaagaagatccaggtgggccagcacgggcactcatcagtagaagatgccacgacagccatggagctctaccggctggtggaggtgcagtgggaacagcaggaggcccgcagcctctggacctgccccgaggacagagaacctgacagcagcacagacatggaacagtacatggaggaccagtactggcccgatgacctggcccacggcagcagaggaggagccagggaggcacaggacagaaggaattgagaagggggcggggctccctggctgggcttccggtgtggccggtaggaagtgggggccaggagagcagcgggcactccttcctgggcagggtggggcaggatgcagtgagccagccccagggccagaggagttggggtcatctgttaccttgacaccctctgcacacagcatagccctctctctctccagggctgttggttctttctcctgactcctgtggttttgctaatggcactttacagactccatggagatgtcaggtggaccatcttctagggcccagcaggagtagggaatgtgccaacagactgcccaggttgccgtggccttccccaccccccagatctcctgagtcatcatgctgtgctaatgaaagggatcatatcatcctctctgcgtttgcaaacgcagagaggaccatagtctaataaaaaacaccctgaacctaataattcaagcgctgctcattacaatcctactgcagctctattagaccctcctacaagccttaaagaacttcg

SEQ ID NO: 31146 - DNA, 1104 bp, Homo sapiens
agcggagtcggagccgggcttgcccgggcatgtgggagctgccggctttccggacgccacgtgcagaccggaagagacacgcggggcttcaggctgctgccccattggaagattactccccaggcttcccttgccccaagcagtgagctgactggaatggtaccccgggaggcccctgagtctgctcagtgcctgtgcccttccctcaccatcccaaatgccaaggatgtgcttcggaagaggcacaagagaaggagccgacagcaccagcggttcatggcccggaaggccttgctgcaggagcaggggctgctgagcatgcctccagaaccagggtcctccccactgcccacccctttcggggcagcgacagcaactgaagctgccagcagtgggaagcagtgtctgagggctggatctggcagtgccccatgcagcagaaggcctgctcccgggaaagcctcagggcccttgcccagcaagtgtgtggctatcgactgtgagatggtgggcacgggaccccgagggcgggtaagcgagctggcccgctgttccattgtgagctaccatggcgatgtcctctatgacaagtacatcaggcctgagatgcccatcgctgactaccgtacccgctggagtggcatcactcggcagcacatgcgcaaggctgtccccttccaggtggcccagaaagagatccttaagctcctgaagggcaaggtggtggtggggcacgcgctgcacaacgacttccaggcgctcaagtatgtccaccctcggagccagacccgggataccaccgttccacaaacttggggtcatagattgtccagtcactggctccctccctgtcagcacagcacagaggaaggggctaactgaatcttttaccacttctggcctggctccagaactttgttctagattccttaaaagtcggtagctgatgtcaaactcaattgagcagtagctttgatcccttggtctgggggtcgaaggaagatggcgctgttatcagcggggaaatgtactatttaagatcagctttgttgtaaaaccatttgttctagaataaaactcaattggaaacgtgaaaaaaaaaac

SEQ ID NO: 31147 - DNA, 6662 bp, Homo sapiens
agccggtccaaggcggtgcgctgggggccggggcgcgtcgcaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcaggaaacattagaggaaatttggagaatttcagcattgcatagaagcagccttacaggtaaacggatttgacgggcaggctctgtcaaaattctgcagaagtttgatcttccttcttaaggactttgtgtgaagtaattctttactgcttttaaattgctgttgatcagcttctgggtttttgggttctaacttttttgggtatattgaagacacagtgtattacattatattacatttttaaacgttaagttatttttctgccattgtaaatacaagtatcaaaatattcttgcaaagaagtaaacatttttctcagcaagcatatccttttagtaagagagtggaatgctaaacagttcttatccagcattttggacatcttttattttttgtcagagatcctgtctacactgaaaatattaattatataaacctgttgtctctcacctctacattggatcacatggtcacctgcctcatggaaatgccttttttaaaacttcgatttgcagaactccactatttttatacctagctacagttttgagaaagaagaatcagaaccctgacccacttacggttgctgggacaattccccctcccgcatgtattgctgcagtgcccaggacagtaaaatggactacaagcggcgcttcctgcttggcgggtccaagcagaaggtgcagcagcaccagcaatacccgatgcctgagctgggccgagcactgagtgctcccctggcatccacggccaccactgcccccctgggcagtctgaccgctgcaggcagctgccaccatgccatgccccacactactcctatcgccgacatccagcagggcatctccaagtatctggatgccctgaacgtcttctgccgtgccagtactttcctcacagatctcttcagcactgtgttcaggaactctcactactcaaaggcagccacacagctcaaagatgtgcaggagcatgtcatggaagcagccagtcggctgacctcggccataaagcctgagatcgccaagatgctaatggaacttagtgctggggctgcaaattttacggatcagaaggaattcagtctccaggacattgaggtgttggggcgatgtttcctgactgtggtgcaagtccatttccagtttttgactcatgcgttacagaaggtccagccggtggctcactcttgctttgctgaggtcatcgtgccagaaaaaaagaacagcggcagtggcggcggcttatctggcatgggccacacacctgaagtagaggaagctgtgcggtcctggcggggggctgctgaggcgacatctagactaagagaaagaggctgtgatggttgcctggcaggaattgaagttcaacaactcttttgttctcaaagtgcagcaattcctgagcaccagctaaaagaactgaacataaaaatcgacagtgctttgcaagcatataagatagctctggaaagcttaggacactgtgaatatgcaatgaaagccggcttccacctgaatccaaaggcgattgaagcaagtttgcagggctgctgcagcgaggcggaagcccagcagacggggcggaggcagacacccccgcagcccatgcagtgtgagctccccaccgtccctgtgcagataggatcgcacttcctgaagggcgtctcctttaatgagtcggccgccgacaatctgaaacttaagacgcatacaatgttacagctgatgaaggaggcaggctgctataatggaatcacatccagggatgattttcctgtgactgaagtgctgaaccaggtttgcccttccacatggcgaggtgcctgcaagacggcggtgcagctgctgtttggccaggctggactggtggtggttgacacagcacagattgagaataaagaagcctatgccccccagatcagtttagaaggctctagaatcgtggttcaagtcccatccacatggtgcctgaaagaagaccctgctaccatgtccctgctgcagagaagccttgatcctgagaagaccctgggtctagtggacgtgctctacacagctgtgctggacctaaaccgctggagggctggaagggagcaagctttaccctgcatacagatccagctgcaaagggagatctgtgattttggcaaccaggctgacctgccttctggaaatggaaacaaatcttcaggtggcctgcagaagacattctccaaactgacatcccggttcaccaagaaagcttcatgtaccagctccagcagcagcacaaattattccatccaaaataccccttccaaaaacatcttcatagctggatgttccgaagagaaggccaaaatgcctggcaatattgatacaaggttacaaagcattttgaacattggtaatttccccaggactacagacccttcacagtcagctcagaattccagtaatacagtggccaatggctttctcatggagaggcgtgagaacttcctgcatggagatgacggcaaggatgagaagggtatgaacttaccaactgatcaggaaatgcaagaggtgatagattttctctcgggctttaacatgggccagtcacatcagggctctccgttggtgacaaggcataattctgctgccacagccatggtgactgagcagaaggcaggagccatgcaaccacagcagccgtcactgcctgtgccccctccaccacgggcaccccaggctggggcacacacacctctgacaccccagccgggactggcacctcagcagcagtccccaaagcagcaacaacctcaagtccaatactaccaacacctactccagcccattggaccgcagcagcccccgccccagcctcgggcacctgggaaatgggtacatggctcatcccagcagccagcgcaggctgttggagcaggtctgtctcctcttggtcagtggcctggcatatctgatctcagttctgacttgtacagcttgggtctggtgagcagctatatggataatgtgatgtcagaggttctgggacagaagccgcagggacctagaaataacacctggcccaaccgtgaccaaagtgatggagtctttggaatgctgggagagattctgccttttgatcctgcagtgggctcagacccagagtttgcacgctatgtggcaggagtgagccaggcgatgcagcagaagcggcaggcccagcacggtcgccggccaggcaacccccggggcaactggccgcctatggatgacgcgcatcggacctggcccttccccgagttcttcacagaaggggatggcctgcacggtggctggtcgggtgctcagggagactctgccagctcgagtgatgagacatcctcagccaacggggacagcttgttctccatgttttcagggcctgacctcgttgctgctgtcaagcagagaaggaaacacagcagtggagagcaagacaccagcacgctgccctcaccacctctcctcaccacggtggaggatgtgaaccaggataacaaaaccaaaacgtggccacccaaagcaccctggcagcacccttccccgcttcccagcacgctgcccagccccagcgcaccactctatgcagtcaccagccctggcagccagtggaacgacaccatgcagatgctgcagtccccagtgtgggccgcaaccaacgactgcagtgccgctgccttctcctatgtgcagaccccaccccagcccccacccccaccagcacacaaggcagcacccaagggcttcaaggccttccctgggaagggtgagcgcaggccagcctatctgccccagtactgaccccaggccagccagcctgcctgcctgcctgcctgcccgcccagagctgtggggatgagtgtccccaccccagggccacttagctgacaccagcccctcagaggaccagtgcgccccatcccagggagggttccttggggacaagggtggttggcagctccaagcctttaaacctggcttctgaaacgatggcatcagagccctggagagccagctggagacacaggcgtctggccttcaggggcttgctagggaacctgcatgcctagtaagcgccacaggtgactctgatgcaggcgccacagccacacttgaagaaacacagctcttgggtttttagtcctgctgtgtgttgggaagacatcaggcctgaaagctgagggcataactgaccattttttggaaaccctctcctccctcctccacaccttgagtgatgaccacaccaatcactgtattttatagctttttttttcatgtaggtttttagttaaaacatctcctgcctaaaatgcattgaatattttaagataacagatatactggctggaggtttgtttaacactatctatatttaagcttatacaaaatgggcaaaatatagaatatttgtgattggaagcagtcacctggggtttctgggggtggacagttcctcgccacccagcagcaccctgggactgcggcctttcccagctttattgaagcagaatggtggaacttgtgccggaggtacactgctgaaggtgcgtggcggtggaccagccagctgctgtccatgtgcagagcaaggctgcacctgctgcccttcgatccttccacacatggccaggacactgccacaatcctcggggtgtggtcaaggggcactcagagacacctgcactagaaattgcattgacattgtgagctggctcagaagacaaaccaattaagatgtagatagaaattaatttaaggtcttttcttaaaaaaaaaatccacctcattttcagttaacatgtgccattaaatagataacatcctgtggatttagggatattttccagccagaatggatccagaagaattgaatggtgcttaaattgagaaataataataaatatatctatatagaatagacatatcccactgtatattaattgaggttacagaaagttctttatataaaacttatttaaatttttcatatttcatctttgaaaaagtctgagaaaaatccataatattttctggtatgaaagtttgacagtattaatattttttttatattttcttaaatcattaaaccattttaatatatgttaactactaataaatggtttattctttctaactccatataagcttttccagcaaagattgtaataacacatttatgttctcgtttttctacagatataagtaaatttatatataaaaataccaaaaagaggctgggcgtggtggctcacgcctgtaatcccagcactttgggaggccgaggcaggtggatcacctaaggtcaggagttcgagaccagcctggccaatatggtgaaaccccatctctactaaaaatacaaaaattagccgggtgtggtggcgtgcgcctgtagtcccagctactcgggaggctgaagcagaagaatcgcttgaacccgggaggcggaggttacagtgagctgagattgtgccactgcactccagcctgggtgacagagtgagattccgtctcaacaagaaaaaaaaaaaagaatatatatatatgtatgtatgtatgtatgtaaacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataata

SEQ ID NO: 31148 - DNA, 533 bp, Homo sapiens
agtttgtccccaaacccggtttattcctttgtcccaatgcagtgggctcagacccagagtttgcacgctatgtggcaggagtgagccaggcgatgcagcagaagcggcaggcccagcacggtcgccggccaggcaacccccggggcaactggccgcctatggatgacgcgcatcggacctggccgtgtcccccgaggggcctgtgagaagagaggctccttgcctgtgtgcattcttttcaggcagttcaattccaagcccccatgtgagagagtgacatgggatgaaatctttaggggtcagagtcatgtggctgactgttagatgccaagtagtgtgatgtatccctgtgaacgtgccattggtatacattcatgattttcaaaacagactcttcagccctagacaaggctcttacatgatggtgcttgtgaggtgaaggcatgtttcacacggcctttatactgaactgagtgtggctgcgaagcccacgtgatttatggaacgctgtcattatagcctatgaaaagcaa

SEQ ID NO: 31149 - DNA, 4616 bp, Homo sapiens
tctagccatgctttcccctcctgtgccaccattagaggatttcactgaatcacactcctcaggccagaatcctagcagaacttccagtcctgcgttagacactgtagatttcatactctccaaacccctgggtgttcatttatatataaaataagtgaacccgataccaacctgagaggtttttcttgctctcaacgccattcttaaatacaaagaggtccattttattattttatatatttgtcttttttttttttaaacaaatttctgtttaaatagggagcaagctttaccctgcatacagatccagctgcaaagggagatctgtgattttggcaaccaggctgacctgccttctggaaatggaaacaaatcttcaggtggcctgcagaagacattctccaaactgacatcccggttcaccaagaaagcttcatgtaccagctccagcagcagcacaaattattccatccaaaataccccttccaaaaacatcttcatagctggatgttccgaagagaaggccaaaatgcctggcaatattgatacaaggttacaaagcattttgaacattggtaatttccccaggactacagacccttcacagtcagctcagaattccagtaatacagtggccaatggctttctcatggagaggcgtgagaacttcctgcatggagatgacggcaaggatgagaagggtatgaacttaccaactgatcaggaaatgcaagaggtgatagattttctctcgggctttaacatgggccagtcacatcagggctctccgttggtgacaaggcataattctgctgccacagccatggtgactgagcagaaggcaggagccatgcaaccacagcagccgtcactgcctgtgccccctccaccacgggcaccccaggctggggcacacacacctctgacaccccagccgggactggcacctcagcagcagtccccaaagcagcaacaacctcaagtccaatactaccaacacctactccagcccattggaccgcagcagcccccgccccagcctcgggcacctgggaaatgggtacatggctcatcccagcagccagcgcaggctgttggagcaggtctgtctcctcttggtcagtggcctggcatatctgatctcagttctgacttgtacagcttgggtctggtgagcagctatatggataatgtgatgtcagaggttctgggacagaagccgcagggacctagaaataacacctggcccaaccgtgaccaaagtgatggagtctttggaatgctgggagagattctgccttttgatcctgcagtgggctcagacccagagtttgcacgctatgtggcaggagtgagccaggcgatgcagcagaagcggcaggcccagcacggtcgccggccaggcaacccccggggcaactggccgcctatggatgacgcgcatcggacctggcccttccccgagttcttcacagaaggggatggcctgcacggtggctggtcgggtgctcagggagactctgccagctcgagtgatgagacatcctcagccaacggggacagcttgttctccatgttttcagggcctgacctcgttgctgctgtcaagcagagaaggaaacacagcagtggagagcaagacaccagcacgctgccctcaccacctctcctcaccacggtggaggatgtgaaccaggataacaaaaccaaaacgtggccacccaaagcaccctggcagcacccttccccgcttcccagcacgctgcccagccccagcgcaccactctatgcagtcaccagccctggcagccagtggaacgacaccatgcagatgctgcagtccccagtgtgggccgcaaccaacgactgcagtgccgctgccttctcctatgtgcagaccccaccccagcccccacccccaccagcacacaaggcagcacccaagggcttcaaggccttccctgggaagggtgagcgcaggccagcctatctgccccagtactgaccccaggccagccagcctgcctgcctgcctgcctgcccgcccagagctgtggggatgagtgtccccaccccagggccacttagctgacaccagcccctcagaggaccagtgcgccccatcccagggagggttccttggggacaagggtggttggcagctccaagcctttaaacctggcttctgaaacgatggcatcagagccctggagagccagctggagacacaggcgtctggccttcaggggcttgctagggaacctgcatgcctagtaagcgccacaggtgactctgatgcaggcgccacagccacacttgaagaaacacagctcttgggtttttagtcctgctgtgtgttgggaagacatcaggcctgaaagctgagggcataactgaccattttttggaaaccctctcctccctcctccacaccttgagtgatgaccacaccaatcactgtattttatagctttttttttcatgtaggtttttagttaaaacatctcctgcctaaaatgcattgaatattttaagataacagatatactggctggaggtttgtttaacactatctatatttaagcttatacaaaatgggcaaaatatagaatatttgtgattggaagcagtcacctggggtttctgggggtggacagttcctcgccacccagcagcaccctgggactgcggcctttcccagctttattgaagcagaatggtggaacttgtgccggaggtacactgctgaaggtgcgtggcggtggaccagccagctgctgtccatgtgcagagcaaggctgcacctgctgcccttcgatccttccacacatggccaggacactgccacaatcctcggggtgtggtcaaggggcactcagagacacctgcactagaaattgcattgacattgtgagctggctcagaagacaaaccaattaagatgtagatagaaattaatttaaggtcttttcttaaaaaaaaaatccacctcattttcagttaacatgtgccattaaatagataacatcctgtggatttagggatattttccagccagaatggatccagaagaattgaatggtgcttaaattgagaaataataataaatatatctatatagaatagacatatcccactgtatattaattgaggttacagaaagttctttatataaaacttatttaaatttttcatatttcatctttgaaaaagtctgagaaaaatccataatattttctggtatgaaagtttgacagtattaatattttttttatattttcttaaatcattaaaccattttaatatatgttaactactaataaatggtttattctttctaactccatataagcttttccagcaaagattgtaataacacatttatgttctcgtttttctacagatataagtaaatttatatataaaaataccaaaaagaggctgggcgtggtggctcacgcctgtaatcccagcactttgggaggccgaggcaggtggatcacctaaggtcaggagttcgagaccagcctggccaatatggtgaaaccccatctctactaaaaatacaaaaattagccgggtgtggtggcgtgcgcctgtagtcccagctactcgggaggctgaagcagaagaatcgcttgaacccgggaggcggaggttacagtgagctgagattgtgccactgcactccagcctgggtgacagagtgagattccgtctcaacaagaaaaaaaaaaaagaatatatatatatgtatgtatgtatgtatgtaaacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataata

SEQ ID NO: 31150 - DNA, 2643 bp, Homo sapiens
gcggcggcggcggcgggctggcctggggtcagtactggggcagatagcctgcctgcctgcctgcctgcccgcccagagctgtggggatgagtgtccccaccccagggccacttagctgacaccagcccctcagaggaccagtgcgccccatcccagggagggttccttggggacaagggtggttggcagctccaagcctttaaacctggcttctgaaacgatggcatcagagccctggagagccagctggagacacaggcgtctggccttcaggggcttgctagggaacctgcatgcctagtaagcgccacaggtgactctgatgcaggcgccacagccacacttgaagaaacacagctcttgggtttttagtcctgctgtgtgttgggaagacatcaggcctgaaagctgagggcataactgaccattttttggaaaccctctcctccctcctccacaccttgagtgatgaccacaccaatcactgtattttatagctttttttttcatgtaggtttttagttaaaacatctcctgcctaaaatgcattgaatattttaagataacagatatactggctggaggtttgtttaacactatctatatttaagcttatacaaaatgggcaaaatatagaatatttgtgattggaagcagtcacctggggtttctgggggtggacagttcctcgccacccagcagcaccctgggactgcggcctttcccagctttattgaagcagaatggtggaacttgtgccggaggtacactgctgaaggtgcgtggcggtggaccagccagctgctgtccatgtgcagagcaaggctgcacctgctgcccttcgatccttccacacatggccaggacactgccacaatcctcggggtgtggtcaaggggcactcagagacacctgcactagaaattgcattgacattgtgagctggctcagaagacaaaccaattaagatgtagatagaaattaatttaaggtcttttcttaaaaaaaaaatccacctcattttcagttaacatgtgccattaaatagataacatcctgtggatttagggatattttccagccagaatggatccagaagaattgaatggtgcttaaattgagaaataataataaatatatctatatagaatagacatatcccactgtatattaattgaggttacagaaagttctttatataaaacttatttaaatttttcatatttcatctttgaaaaagtctgagaaaaatccataatattttctggtatgaaagtttgacagtattaatattttttttatattttcttaaatcattaaaccattttaatatatgttaactactaataaatggtttattctttctaactccatataagcttttccagcaaagattgtaataacacatttatgttctcgtttttctacagatataagtaaatttatatataaaaataccaaaaagaggctgggcgtggtggctcacgcctgtaatcccagcactttgggaggccgaggcaggtggatcacctaaggtcaggagttcgagaccagcctggccaatatggtgaaaccccatctctactaaaaatacaaaaattagccgggtgtggtggcgtgcgcctgtagtcccagctactcgggaggctgaagcagaagaatcgcttgaacccgggaggcggaggttacagtgagctgagattgtgccactgcactccagcctgggtgacagagtgagattccgtctcaacaagaaaaaaaaaaaagaatatatatatatgtatgtatgtatgtatgtaaacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataata

SEQ ID NO: 31151 - DNA, 7198 bp, Homo sapiens
agccggtccaaggcggtgcgctgggggccggggcgcgtcgcaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcaggaaacattagaggaaatttggagaatttcagcattgcatagaagcagccttacaggtaaacggatttgacgggcaggctctgtcaaaattctgcagaagtttgatcttccttcttaaggactttgtgtgaagtaattctttactgcttttaaattgctgttgatcagcttctgggtttttgggttctaacttttttgggtatattgaagacacagtgtattacattatattacatttttaaacgttaagttatttttctgccattgtaaatacaagtatcaaaatattcttgcaaagaagtaaacatttttctcagcaagcatatccttttagtaagagagtggaatgctaaacagttcttatccagcattttggacatcttttattttttgtcagagatcctgtctacactgaaaatattaattatataaacctgttgtctctcacctctacattggatcacatggtcacctgcctcatggaaatgccttttttaaaacttcgatttgcagaactccactatttttatacctagctacagttttgagaaagaagaatcagaaccctgacccacttacggttgctgggacaattccccctcccgcatgtattgctgcagtgcccaggacagtaaaatggactacaagcggcgcttcctgcttggcgggtccaagcagaaggtgcagcagcaccagcaatacccgatgcctgagctgggccgagcactgagtgctcccctggcatccacggccaccactgcccccctgggcagtctgaccgctgcaggcagctgccaccatgccatgccccacactactcctatcgccgacatccagcagggcatctccaagtatctggatgccctgaacgtcttctgccgtgccagtactttcctcacagatctcttcagcactgtgttcaggaactctcactactcaaaggcagccacacagctcaaagatgtgcaggagcatgtcatggaagcagccagtcggctgacctcggccataaagcctgagatcgccaagatgctaatggaacttagtgctggggctgcaaattttacggatcagaaggaattcagtctccaggacattgaggtgttggggcgatgtttcctgactgtggtgcaagtccatttccagtttttgactcatgcgttacagaaggtccagccggtggctcactcttgctttgctgaggtcatcgtgccagaaaaaaagaacagcggcagtggcggcggcttatctggcatgggccacacacctgaagtagaggaagctgtgcggtcctggcggggggctgctgaggcgacatctagactaagagaaagaggctgtgatggttgcctggcaggaattgaagttcaacaactcttttgttctcaaagtgcagcaattcctgagcaccagctaaaagaactgaacataaaaatcgacagtgctttgcaagcatataagatagctctggaaagcttaggacactgtgaatatgcaatgaaagccggcttccacctgaatccaaaggcgattgaagcaagtttgcagggctgctgcagcgaggcggaagcccagcagacggggcggaggcagacacccccgcagcccatgcagtgtgagctccccaccgtccctgtgcagataggatcgcacttcctgaagggcgtctcctttaatgagtcggccgccgacaatctgaaacttaagacgcatacaatgttacagctgatgaaggaggcaggctgctataatggaatcacatccagggatgattttcctgtgactgaagtgctgaaccaggtttgcccttccacatggcgaggtgcctgcaagacggcggtgcagctgctgtttggccaggctggactggtggtggttgacacagcacagattgagaataaagaagcctatgccccccagatcagtttagaaggctctagaatcgtggttcaagtcccatccacatggtgcctgaaagaagaccctgctaccatgtccctgctgcagagaagccttgatcctgagaagaccctgggtctagtggacgtgctctacacagctgtgctggacctaaaccgctggagggctggaagggagcaagctttaccctgcatacagatccagctgcaaagggagatctgtgattttggcaaccaggctgacctgccttctggaaatggaaacaaatcttcaggtggcctgcagaagacattctccaaactgacatcccggttcaccaagaaagcttcatgtaccagctccagcagcagcacaaattattccatccaaaataccccttccaaaaacatcttcatagctggatgttccgaagagaaggccaaaatgcctggcaatattgatacaaggttacaaagcattttgaacattggtaatttccccaggactacagacccttcacagtcagctcagaattccagtaatacagtggccaatggctttctcatggagaggcgtgagaacttcctgcatggagatgacggcaaggatgagaagggtatgaacttaccaactgatcaggaaatgcaagaggtgatagattttctctcgggctttaacatgggccagtcacatcagggctctccgttggtgacaaggcataattctgctgccacagccatggtgactgagcagaaggcaggagccatgcaaccacagcagccgtcactgcctgtgccccctccaccacgggcaccccaggctggggcacacacacctctgacaccccagccgggactggcacctcagcagcagtccccaaagcagcaacaacctcaagtccaatactaccaacacctactccagcccattggaccgcagcagcccccgccccagcctcgggcacctgggaaatgggtacatggctcatcccagcagccagcgcaggctgttggagcaggtctgtctcctcttggtcagtggcctggcatatctgatctcagttctgacttgtacagcttgggtctggtgagcagctatatggataatgtgatgtcagaggttctgggacagaagccgcagggacctagaaataacacctggcccaaccgtgaccaaagtgatggagtctttggaatgctgggagagattctgccttttgatcctgcagtgggctcagacccagagtttgcacgctatgtggcaggagtgagccaggcgatgcagcagaagcggcaggcccagcacggtcgccggccaggcaacccccggggcaactggccgcctatggatgacgcgcatcggacctggcccttccccgagttcttcacagaaggggatggcctgcacggtggctggtcgggtgctcagggagactctgccagctcgagtgatgagacatcctcagccaacggggacagcttgttctccatgttttcagggcctgacctcgttgctgctgtcaagcagagaaggaaacacagcagtggagagcaagacaccagcacgctgccctcaccacctctcctcaccacggtggaggatgtgaaccaggataacaaaaccaaaacgtggccacccaaagcaccctggcagcacccttccccgcttcccagcacgctgcccagccccagcgcaccactctatgcagtcaccagccctggcagccagtggaacgacaccatgcagatgctgcagtccccagtgtgggccgcaaccaacgactgcagtgccgctgccttctcctatgtgcagaccccaccccagcccccacccccaccagcacacaaggcagcacccaagggcttcaaggccttccctgggaagggtgagcgcaggccagcctatctgccccagtactgaccccaggccagccagcctgcctgcctgcctgcctgcccgcccagagctgtggggatgagtgtccccaccccagggccacttagctgacaccagcccctcagaggaccagtgcgccccatcccagggagggttccttggggacaagggtggttggcagctccaagcctttaaacctggcttctgaaacgatggcatcagagccctggagagccagctggagacacaggcgtctggccttcaggggcttgctagggaacctgcatgcctagtaagcgccacaggtgactctgatgcaggcgccacagccacacttgaagaaacacagctcttgggtttttagtcctgctgtgtgttgggaagacatcaggcctgaaagctgagggcataactgaccattttttggaaaccctctcctccctcctccacaccttgagtgatgaccacaccaatcactgtattttatagctttttttttcatgtaggtttttagttaaaacatctcctgcctaaaatgcattgaatattttaagataacagatatactggctggaggtttgtttaacactatctatatttaagcttatacaaaatgggcaaaatatagaatatttgtgattggaagcagtcacctggggtttctgggggtggacagttcctcgccacccagcagcaccctgggactgcggcctttcccagctttattgaagcagaatggtggaacttgtgccggaggtacactgctgaaggtgcgtggcggtggaccagccagctgctgtccatgtgcagagcaaggctgcacctgctgcccttcgatccttccacacatggccaggacactgccacaatcctcggggtgtggtcaaggggcactcagagacacctgcactagaaattgcattgacattgtgagctggctcagaagacaaaccaattaagatgtagatagaaattaatttaaggtcttttcttaaaaaaaaaatccacctcattttcagttaacatgtgccattaaatagataacatcctgtggatttagggatattttccagccagaatggatccagaagaattgaatggtgcttaaattgagaaataataataaatatatctatatagaatagacatatcccactgtatattaattgaggttacagaaagttctttatataaaacttatttaaatttttcatatttcatctttgaaaaagtctgagaaaaatccataatattttctggtatgaaagtttgacagtattaatattttttttatattttcttaaatcattaaaccattttaatatatgttaactactaataaatggtttattctttctaactccatataagcttttccagcaaagattgtaataacacatttatgttctcgtttttctacagatataagtaaatttatatataaaaataccaaaaagaggctgggcgtggtggctcacgcctgtaatcccagcactttgggaggccgaggcaggtggatcacctaaggtcaggagttcgagaccagcctggccaatatggtgaaaccccatctctactaaaaatacaaaaattagccgggtgtggtggcgtgcgcctgtagtcccagctactcgggaggctgaagcagaagaatcgcttgaacccgggaggcggaggttacagtgagctgagattgtgccactgcactccagcctgggtgacagagtgagattccgtctcaacaagaaaaaaaaaaaagaatatatatatatgtatgtatgtatgtatgtaaacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataataaaaaaaaaaaaaaaaaaaaaaaaaaaaaaaaaaaaaaaaacaaaaaaaaaaaaaaaaaaacaaaaaaaaaacaagatgtctgtgcgcgcggcgccgcgcgccgccgccccgacaaagaaacttgttcaaaaacacaactcgtggtgggagggcgcggcggcgcgccccacaagacgagtaggagcgagaacgagggtgacaacaagagcgtcctcccagagagagagaagcccgcggagagacagaaacaacacagggcggcgggcgttctcctcaccacaacaaaaataaaaaacccgccccgcggggggaggacccccgcgagggcttcttagaaaaaacacccccaagagcggagggtagctcgaagggagcacaatcaggggggagatcatccaaaacaaggagggggagaataccacaagacgcgcggcgcactaaagaataaaaaaaaatcgaccccgcccctcttgcttgcggtggcataaaaacacaagaaaacaataaagaccaaaacaaacagacgaagcaagagc

SEQ ID NO: 31152 - DNA, 6682 bp, Homo sapiens
agccggtccaaggcggtgcgctgggggccggggcgcgtcgcaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcaggaaacattagaggaaatttggagaatttcagcattgcatagaagcagccttacaggtaaacggatttgacgggcaggctctgtcaaaattctgcagaagtttgatcttccttcttaaggactttgtgtgaagtaattctttactgcttttaaattgctgttgatcagcttctgggtttttgggttctaacttttttgggtatattgaagacacagtgtattacattatattacatttttaaacgttaagttatttttctgccattgtaaatacaagtatcaaaatattcttgcaaagaagtaaacatttttctcagcaagcatatccttttagtaagagagtggaatgctaaacagttcttatccagcattttggacatcttttattttttgtcagagatcctgtctacactgaaaatattaattatataaacctgttgtctctcacctctacattggatcacatggtcacctgcctcatggaaatgccttttttaaaacttcgatttgcagaactccactatttttatacctagctacagttttgagaaagaagaatcagaaccctgacccacttacggttgctgggacaattccccctcccgcatgtattgctgcagtgcccaggacagtaaaatggactacaagcggcgcttcctgcttggcgggtccaagcagaaggtgcagcagcaccagcaatacccgatgcctgagctgggccgagcactgagtgctcccctggcatccacggccaccactgcccccctgggcagtctgaccgctgcaggcagctgccaccatgccatgccccacactactcctatcgccgacatccagcagggcatctccaagtatctggatgccctgaacgtcttctgccgtgccagtactttcctcacagatctcttcagcactgtgttcaggaactctcactactcaaaggcagccacacagctcaaagatgtgcaggagcatgtcatggaagcagccagtcggctgacctcggccataaagcctgagatcgccaagatgctaatggaacttagtgctggggctgcaaattttacggatcagaaggaattcagtctccaggacattgaggtgttggggcgatgtttcctgactgtggtgcaagtccatttccagtttttgactcatgcgttacagaaggtccagccggtggctcactcttgctttgctgaggtcatcgtgccagaaaaaaagaacagcggcagtggcggcggcttatctggcatgggccacacacctgaagtagaggaagctgtgcggtcctggcggggggctgctgaggcgacatctagactaagagaaagaggctgtgatggttgcctggcaggaattgaagttcaacaactcttttgttctcaaagtgcagcaattcctgagcaccagctaaaagaactgaacataaaaatcgacagtgctttgcaagcatataagatagctctggaaagcttaggacactgtgaatatgcaatgaaagccggcttccacctgaatccaaaggcgattgaagcaagtttgcagggctgctgcagcgaggcggaagcccagcagacggggcggaggcagacacccccgcagcccatgcagtgtgagctccccaccgtccctgtgcagataggatcgcacttcctgaagggcgtctcctttaatgagtcggccgccgacaatctgaaacttaagacgcatacaatgttacagctgatgaaggaggcaggctgctataatggaatcacatccagggatgattttcctgtgactgaagtgctgaaccaggtttgcccttccacatggcgaggtgcctgcaagacggcggtgcagctgctgtttggccaggctggactggtggtggttgacacagcacagattgagaataaagaagcctatgccccccagatcagtttagaaggctctagaatcgtggttcaagtcccatccacatggtgcctgaaagaagaccctgctaccatgtccctgctgcagagaagccttgatcctgagaagaccctgggtctagtggacgtgctctacacagctgtgctggacctaaaccgctggagggctggaagggagcaagctttaccctgcatacagatccagctgcaaagggagatctgtgattttggcaaccaggctgacctgccttctggaaatggaaacaaatcttcaggtggcctgcagaagacattctccaaactgacatcccggttcaccaagaaagcttcatgtaccagctccagcagcagcacaaattattccatccaaaataccccttccaaaaacatcttcatagctggatgttccgaagagaaggccaaaatgcctggcaatattgatacaaggttacaaagcattttgaacattggtaatttccccaggactacagacccttcacagtcagctcagaattccagtaatacagtggccaatggctttctcatggagaggcgtgagaacttcctgcatggagatgacggcaaggatgagaagggtatgaacttaccaactgatcaggaaatgcaagaggtgatagattttctctcgggctttaacatgggccagtcacatcagggctctccgttggtgacaaggcataattctgctgccacagccatggtgactgagcagaaggcaggagccatgcaaccacagcagccgtcactgcctgtgccccctccaccacgggcaccccaggctggggcacacacacctctgacaccccagccgggactggcacctcagcagcagtccccaaagcagcaacaacctcaagtccaatactaccaacacctactccagcccattggaccgcagcagcccccgccccagcctcgggcacctgggaaatgggtacatggctcatcccagcagccagcgcaggctgttggagcaggtctgtctcctcttggtcagtggcctggcatatctgatctcagttctgacttgtacagcttgggtctggtgagcagctatatggataatgtgatgtcagaggttctgggacagaagccgcagggacctagaaataacacctggcccaaccgtgaccaaagtgatggagtctttggaatgctgggagagattctgccttttgatcctgcagtgggctcagacccagagtttgcacgctatgtggcaggagtgagccaggcgatgcagcagaagcggcaggcccagcacggtcgccggccaggcaacccccggggcaactggccgcctatggatgacgcgcatcggacctggcccttccccgagttcttcacagaaggggatggcctgcacggtggctggtcgggtgctcagggagactctgccagctcgagtgatgagacatcctcagccaacggggacagcttgttctccatgttttcagggcctgacctcgttgctgctgtcaagcagagaaggaaacacagcagtggagagcaagacaccagcacgctgccctcaccacctctcctcaccacggtggaggatgtgaaccaggataacaaaaccaaaacgtggccacccaaagcaccctggcagcacccttccccgcttcccagcacgctgcccagccccagcgcaccactctatgcagtcaccagccctggcagccagtggaacgacaccatgcagatgctgcagtccccagtgtgggccgcaaccaacgactgcagtgccgctgccttctcctatgtgcagaccccaccccagcccccacccccaccagcacacaaggcagcacccaagggcttcaaggccttccctgggaagggtgagcgcaggccagcctatctgccccagtactgaccccaggccagccagcctgcctgcctgcctgcctgcccgcccagagctgtggggatgagtgtccccaccccagggccacttagctgacaccagcccctcagaggaccagtgcgccccatcccagggagggttccttggggacaagggtggttggcagctccaagcctttaaacctggcttctgaaacgatggcatcagagccctggagagccagctggagacacaggcgtctggccttcaggggcttgctagggaacctgcatgcctagtaagcgccacaggtgactctgatgcaggcgccacagccacacttgaagaaacacagctcttgggtttttagtcctgctgtgtgttgggaagacatcaggcctgaaagctgagggcataactgaccattttttggaaaccctctcctccctcctccacaccttgagtgatgaccacaccaatcactgtattttatagctttttttttcatgtaggtttttagttaaaacatctcctgcctaaaatgcattgaatattttaagataacagatatactggctggaggtttgtttaacactatctatatttaagcttatacaaaatgggcaaaatatagaatatttgtgattggaagcagtcacctggggtttctgggggtggacagttcctcgccacccagcagcaccctgggactgcggcctttcccagctttattgaagcagaatggtggaacttgtgccggaggtacactgctgaaggtgcgtggcggtggaccagccagctgctgtccatgtgcagagcaaggctgcacctgctgcccttcgatccttccacacatggccaggacactgccacaatcctcggggtgtggtcaaggggcactcagagacacctgcactagaaattgcattgacattgtgagctggctcagaagacaaaccaattaagatgtagatagaaattaatttaaggtcttttcttaaaaaaaaaatccacctcattttcagttaacatgtgccattaaatagataacatcctgtggatttagggatattttccagccagaatggatccagaagaattgaatggtgcttaaattgagaaataataataaatatatctatatagaatagacatatcccactgtatattaattgaggttacagaaagttctttatataaaacttatttaaatttttcatatttcatctttgaaaaagtctgagaaaaatccataatattttctggtatgaaagtttgacagtattaatattttttttatattttcttaaatcattaaaccattttaatatatgttaactactaataaatggtttattctttctaactccatataagcttttccagcaaagattgtaataacacatttatgttctcgtttttctacagatataagtaaatttatatataaaaataccaaaaagaggctgggcgtggtggctcacgcctgtaatcccagcactttgggaggccgaggcaggtggatcacctaaggtcaggagttcgagaccagcctggccaatatggtgaaaccccatctctactaaaaatacaaaaattagccgggtgtggtggcgtgcgcctgtagtcccagctactcgggaggctgaagcagaagaatcgcttgaacccgggaggcggaggttacagtgagctgagattgtgccactgcactccagcctgggtgacagagtgagattccgtctcaacaagaaaaaaaaaaaagaatatatatatatgtatgtatgtatgtatgtaaacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataatactttgtatccttgtttaaaa

SEQ ID NO: 31153 - DNA, 1593 bp, Homo sapiens
ccgaccgccatactcggggttaaactaagtgatcatcaatgtctatttcagctaattaaacattatgatttcaaataataataaatatatctatatagaatagacatatcccactgtatattaattgaggttacagaaagttctttatataaaacttatttaaatttttcatatttcatctttgaaaaagtctgagaaaaatccataatattttctggtatgaaagtttgacagtattaatattttttttatattttcttaaatcattaaaccattttaatatatgttaactactaataaatggtttattctttctaactccatataagcttttccagcaaagattgtaataacacatttatgttctcgtttttctacagatataagtaaatttatatataaaaataccaaaaagaggctgggcgtggtggctcacgcctgtaatcccagcactttgggaggccgaggcaggtggatcacctaaggtcaggagttcgagaccagcctggccaatatggtgaaaccccatctctactaaaaatacaaaaattagccgggtgtggtggcgtgcgcctgtagtcccagctactcgggaggctgaagcagaagaatcgcttgaacccgggaggcggaggttacagtgagctgagattgtgccactgcactccagcctgggtgacagagtgagattccgtctcaacaagaaaaaaaaaaaagaatatatatatatgtatgtatgtatgtatgtaaacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataata

SEQ ID NO: 31154 - DNA, 1369 bp, Homo sapiens
ccatatgttttttttgacactttctgtaaacgccatctgtgcttttctcccatttgtactgccctgtatatccccgttcagcattgccagtgtttccagccacctcttaaagcattctgaagtttcattttattctttgccacacttaagatgttcagatggaatgagcaaatctcctgtcaatagccaggaaaatactagatcaaactttagcttaagtgggatcagcatataacctctatctggctgaccccaatgctttgatgctttgttaacgttcaggttatcagttggccaaagtcatcatctgattttcgaagttgttagctaatgactctaggctacatacagagcaccaagacaatggactttttttgagttggagttttgctcttgtcacccaggcggaggttacagtgagctgagattgtgccactgcactccagcctgggtgacagagtgagattccgtctcaacaagaaaaaaaaaaaagaatatatatatatgtatgtatgtatgtatgtaaacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataata

SEQ ID NO: 31155 - DNA, 954 bp, Homo sapiens
ttttgagacagagtctcactctttcgcccagcctgggtgacagagtgagattccgtctcaacaagaaaaaaaaaaaagaatatatatatatgtatgtatgtatgtatgtaaacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataata

SEQ ID NO: 31156 - DNA, 5578 bp, Homo sapiens
agccggtccaaggcggtgcgctgggggccggggcgcgtcgcaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcaggaaacattagaggaaatttggagaatttcagcattgcatagaagcagccttacaggtaaacggatttgacgggcaggctctgtcaaaattctgcagaagtttgatcttccttcttaaggactttgtgtgaagtaattctttactgcttttaaattgctgttgatcagcttctgggtttttgggttctaacttttttgggtatattgaagacacagtgtattacattatattacatttttaaacgttaagttatttttctgccattgtaaatacaagtatcaaaatattcttgcaaagaagtaaacatttttctcagcaagcatatccttttagtaagagagtggaatgctaaacagttcttatccagcattttggacatcttttattttttgtcagagatcctgtctacactgaaaatattaattatataaacctgttgtctctcacctctacattggatcacatggtcacctgcctcatggaaatgccttttttaaaacttcgatttgcagaactccactatttttatacctagctacagttttgagaaagaagaatcagaaccctgacccacttacggttgctgggacaattccccctcccgcatgtattgctgcagtgcccaggacagtaaaatggactacaagcggcgcttcctgcttggcgggtccaagcagaaggtgcagcagcaccagcaatacccgatgcctgagctgggccgagcactgagtgctcccctggcatccacggccaccactgcccccctgggcagtctgaccgctgcaggcagctgccaccatgccatgccccacactactcctatcgccgacatccagcagggcatctccaagtatctggatgccctgaacgtcttctgccgtgccagtactttcctcacagatctcttcagcactgtgttcaggaactctcactactcaaaggcagccacacagctcaaagatgtgcaggagcatgtcatggaagcagccagtcggctgacctcggccataaagcctgagatcgccaagatgctaatggaacttagtgctggggctgcaaattttacggatcagaaggaattcagtctccaggacattgaggtgttggggcgatgtttcctgactgtggtgcaagtccatttccagtttttgactcatgcgttacagaaggtccagccggtggctcactcttgctttgctgaggtcatcgtgccagaaaaaaagaacagcggcagtggcggcggcttatctggcatgggccacacacctgaagtagaggaagctgtgcggtcctggcggggggctgctgaggcgacatctagactaagagaaagaggctgtgatggttgcctggcaggaattgaagttcaacaactcttttgttctcaaagtgcagcaattcctgagcaccagctaaaagaactgaacataaaaatcgacagtgctttgcaagcatataagatagctctggaaagcttaggacactgtgaatatgcaatgaaagccggcttccacctgaatccaaaggcgattgaagcaagtttgcagggctgctgcagcgaggcggaagcccagcagacggggcggaggcagacacccccgcagcccatgcagtgtgagctccccaccgtccctgtgcagataggatcgcacttcctgaagggcgtctcctttaatgagtcggccgccgacaatctgaaacttaagacgcatacaatgttacagctgatgaaggaggcaggctgctataatggaatcacatccagggatgattttcctgtgactgaagtgctgaaccaggtttgcccttccacatggcgaggtgcctgcaagacggcggtgcagctgctgtttggccaggctggactggtggtggttgacacagcacagattgagaataaagaagcctatgccccccagatcagtttagaaggctctagaatcgtggttcaagtcccatccacatggtgcctgaaagaagaccctgctaccatgtccctgctgcagagaagccttgatcctgagaagaccctgggtctagtggacgtgctctacacagctgtgctggacctaaaccgctggagggctggaagggagcaagctttaccctgcatacagatccagctgcaaagggagatctgtgattttggcaaccaggctgacctgccttctggaaatggaaacaaatcttcaggtggcctgcagaagacattctccaaactgacatcccggttcaccaagaaagcttcatgtaccagctccagcagcagcacaaattattccatccaaaataccccttccaaaaacatcttcatagctggatgttccgaagagaaggccaaaatgcctggcaatattgatacaaggttacaaagcattttgaacattggtaatttccccaggactacagacccttcacagtcagctcagaattccagtaatacagtggccaatggctttctcatggagaggcgtgagaacttcctgcatggagatgacggcaaggatgagaagggtatgaacttaccaactgatcaggaaatgcaagaggtgatagattttctctcgggctttaacatgggccagtcacatcagggctctccgttggtgacaaggcataattctgctgccacagccatggtgactgagcagaaggcaggagccatgcaaccacagcagccgtcactgcctgtgccccctccaccacgggcaccccaggctggggcacacacacctctgacaccccagccgggactggcacctcagcagcagtccccaaagcagcaacaacctcaagtccaatactaccaacacctactccagcccattggaccgcagcagcccccgccccagcctcgggcacctgggaaatgggtacatggctcatcccagcagccagcgcaggctgttggagcaggtctgtctcctcttggtcagtggcctggcatatctgatctcagttctgacttgtacagcttgggtctggtgagcagctatatggataatgtgatgtcagaggttctgggacagaagccgcagggacctagaaataacacctggcccaaccgtgaccaaagtgatggagtctttggaatgctgggagagattctgccttttgatcctgcagtgggctcagacccagagtttgcacgctatgtggcaggagtgagccaggcgatgcagcagaagcggcaggcccagcacggtcgccggccaggcaacccccggggcaactggccgcctatggatgacgcgcatcggacctggcccttccccgagttcttcacagaaggggatggcctgcacggtggctggtcgggtgctcagggagactctgccagctcgagtgatgagacatcctcagccaacggggacagcttgttctccatgttttcagggcctgacctcgttgctgctgtcaagcagagaaggaaacacagcagtggagagcaagacaccagcacgctgccctcaccacctctcctcaccacggtggaggatgtgaaccaggataacaaaaccaaaacgtggccacccaaagcaccctggcagcacccttccccgcttcccagcacgctgcccagccccagcgcaccactctatgcagtcaccagccctggcagccagtggaacgacaccatgcagatgctgcagtccccagtgtgggccgcaaccaacgactgcagtgccgctgccttctcctatgtgcagaccccaccccagcccccacccccaccagcacacaaggcagcacccaagggcttcaaggccttccctgggaagggtgagcgcaggccagcctatctgccccagtactgaccccaggccagccagcctgcctgcctgcctgcctgcccgcccagagctgtggggatgagtgtccccaccccagggccacttagctgacaccagcccctcagaggaccagtgcgccccatcccagggagggttccttggggacaagggtggttggcagctccaagcctttaaacctggcttctgaaacgatggcatcagagccctggagagccagctggagacacaggcgtctggccttcaggggcttgctagggaacctgcatgcctagtaagcgccacaggtgactctgatgcaggcgccacagccacacttgaagaaacacagctcttgggtttttagtcctgctgtgtgttgggaagacatcaggcctgaaagctgagggcataactgaccattttttggaaaccctctcctccctcctccacaccttgagtgatgaccacaccaatcactgtattttatagctttttttttcatgtaggtttttagttaaaacatctcctgcctaaaatgcattgaatattttaagataacagatatactggctggaggtttgtttaacactatctatatttaagcttatacaaaatgggcaaaatatagaatatttgtgattggaagcagtcacctggggtttctgggggtggacagttcctcgccacccagcagcaccctgggactgcggcctttcccagctttattgaagcagaatggtggaacttgtgccggaggtacactgctgaaggtgcgtggcggtggaccagccagctgctgtccatgtgcagagcaaggctgcacctgctgcccttcgatccttccacacatggccaggacactgccacaatcctcggggtgtggtcaaggggcactcagagacacctgcactagaaattgcattgacattgtgagctggctcagaagacaaaccaattaagatgtagatagaaattaatttaaggtcttttcttaaaaaaaaaatccacctcattttcagttaacatgtgccattaaatagataacatcctgtggatttagggatattttccagccagaatggatccagaagaattgaatggtgcttaaattgagaaataataataaatatatctatatagaatagacatatcccactgtatattaattgaggttacagaaagttctttatataaaacttatttaaatttttcatatttcatctttgaaaaagtctgagaaaaatccataatattttctggtatgaaagtttgacagtattaatattttttttatattttcttaaatcattaaaccattttaatatatgttaactactaataaatggtttattctttctaactccatataagcttttccagcaaagattgtaataacacatttatgttctcgtttttctacagatataagtaaatttatatataaaaataccaaaaagaggctgggcgtggtggctcacgcctgtaatcccaaagtgctgagattacaggcatgagccacacaccggcctatttcctccatatttttaaaaa

SEQ ID NO: 31157 - DNA, 4008 bp, Homo sapiens
agccggtccaaggcggtgcgctgggggccggggcgcgtcgcaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcaggaaacattagaggaaatttggagaatttcagcattgcatagaagcagccttacaggtaaacggatttgacgggcaggctctgtcaaaattctgcagaagtttgatcttccttcttaaggactttgtgtgaagtaattctttactgcttttaaattgctgttgatcagcttctgggtttttgggttctaacttttttgggtatattgaagacacagtgtattacattatattacatttttaaacgttaagttatttttctgccattgtaaatacaagtatcaaaatattcttgcaaagaagtaaacatttttctcagcaagcatatccttttagtaagagagtggaatgctaaacagttcttatccagcattttggacatcttttattttttgtcagagatcctgtctacactgaaaatattaattatataaacctgttgtctctcacctctacattggatcacatggtcacctgcctcatggaaatgccttttttaaaacttcgatttgcagaactccactatttttatacctagctacagttttgagaaagaagaatcagaaccctgacccacttacggttgctgggacaattccccctcccgcatgtattgctgcagtgcccaggacagtaaaatggactacaagcggcgcttcctgcttggcgggtccaagcagaaggtgcagcagcaccagcaatacccgatgcctgagctgggccgagcactgagtgctcccctggcatccacggccaccactgcccccctgggcagtctgaccgctgcaggcagctgccaccatgccatgccccacactactcctatcgccgacatccagcagggcatctccaagtatctggatgccctgaacgtcttctgccgtgccagtactttcctcacagatctcttcagcactgtgttcaggaactctcactactcaaaggcagccacacagctcaaagatgtgcaggagcatgtcatggaagcagccagtcggctgacctcggccataaagcctgagatcgccaagatgctaatggaacttagtgctggggctgcaaattttacggatcagaaggaattcagtctccaggacattgaggtgttggggcgatgtttcctgactgtggtgcaagtccatttccagtttttgactcatgcgttacagaaggtccagccggtggctcactcttgctttgctgaggtcatcgtgccagaaaaaaagaacagcggcagtggcggcggcttatctggcatgggccacacacctgaagtagaggaagctgtgcggtcctggcggggggctgctgaggcgacatctagactaagagaaagaggctgtgatggttgcctggcaggaattgaagttcaacaactcttttgttctcaaagtgcagcaattcctgagcaccagctaaaagaactgaacataaaaatcgacagtgctttgcaagcatataagatagctctggaaagcttaggacactgtgaatatgcaatgaaagccggcttccacctgaatccaaaggcgattgaagcaagtttgcagggctgctgcagcgaggcggaagcccagcagacggggcggaggcagacacccccgcagcccatgcagtgtgagctccccaccgtccctgtgcagataggatcgcacttcctgaagggcgtctcctttaatgagtcggccgccgacaatctgaaacttaagacgcatacaatgttacagctgatgaaggaggcaggctgctataatggaatcacatccagggatgattttcctgtgactgaagtgctgaaccaggtttgcccttccacatggcgaggtgcctgcaagacggcggtgcagctgctgtttggccaggctggactggtggtggttgacacagcacagattgagaataaagaagcctatgccccccagatcagtttagaaggctctagaatcgtggttcaagtcccatccacatggtgcctgaaagaagaccctgctaccatgtccctgctgcagagaagccttgatcctgagaagaccctgggtctagtggacgtgctctacacagctgtgctggacctaaaccgctggagggctggaagggagcaagctttaccctgcatacagatccagctgcaaagggagatctgtgattttggcaaccaggctgacctgccttctggaaatggaaacaaatcttcaggtggcctgcagaagacattctccaaactgacatcccggttcaccaagaaagcttcatgtaccagctccagcagcagcacaaattattccatccaaaataccccttccaaaaacatcttcatagctggatgttccgaagagaaggccaaaatgcctggcaatattgatacaaggttacaaagcattttgaacattggtaatttccccaggactacagacccttcacagtcagctcagaattccagtaatacagtggccaatggctttctcatggagaggcgtgagaacttcctgcatggagatgacggcaaggatgagaagggtatgaacttaccaactgatcaggaaatgcaagaggtgatagattttctctcgggctttaacatgggccagtcacatcagggctctccgttggtgacaaggcataattctgctgccacagccatggtgactgagcagaaggcaggagccatgcaaccacagcagccgtcactgcctgtgccccctccaccacgggcaccccaggctggggcacacacacctctgacaccccagccgggactggcacctcagcagcagtccccaaagcagcaacaacctcaagtccaatactaccaacacctactccagcccattggaccgcagcagcccccgccccagcctcgggcacctgggaaatgggtacatggctcatcccagcagccagcgcaggctgttggagcaggtctgtctcctcttggtcagtggcctggcatatctgatctcagttctgacttgtacagcttgggtctggtgagcagctatatggataatgtgatgtcagaggttctgggacagaagccgcagggacctagaaataacacctggcccaaccgtgaccaaagtgatggagtctttggaatgctgggagagattctgccttttgatcctgcaggtatgtgaggcctcccatccctcgcccagtgtcaacagcaaatgcaactgccgaggtcttcccagggcctgtctgctgcagccttacttgtgaaggtgaaatcatttaatccccctttacgaccctttctcactgtggaggcaagtatggggcagatctaccaagatgggaaacagtggtgagaaaggggctgagaacatgagtggactatttttcttactttatagagaacagaactgaggctaagagaggttacttgaacagctcaaagtcccatagttcaagtaggctccagtctaggcctgcctactcccggcagccaaggtcagcagccctttgtggggtgcttttttcctgattatataacctgttctttgcgatgctttttttttttgcctaaactctaggacctatgacaggtgacagacaccctcctgccttcatagaatacagcttctcctgggctagacaatgaaaataccaccagagtcatcttaaaaaattagagaaggaatttacaaacaagaacaaactaggaggaggaattaagggggaaaagccaaaaataagtaaattagaaagaaaaatagagtagaaattgcaaataactctaaaggatctttggaagaccaataaaatgtataagcca

SEQ ID NO: 31158 - DNA, 447 bp, Homo sapiens
ccagggttccacctcccccttgtgttgctgaagcagggcctgcccttaaggtccccactgagggcgcctggtgggcctggagcgtgggaggagggtcaccagtgccccttgcacagcagcgcatgggggaaacagcatggctcattcactaagaaccacggggtggaggcggtgctcaggcctgtaatcccagcactgtgggaggctgaggcaggactagcacttgagcccaagagttcgagaccagcctggcaacattggaaaccccaccttactaaaaatacaaaacattagctcggcgtggtggtacacgcccgtggtcacagcgtcttgggaggctgaaatgggggaattgcttgaggcgggaggtcgaggctgcagtgagctgacattgcaccactttgggtgcacaccagcctcggtgacagaccgagaccctgcctcaaa

SEQ ID NO: 31159 - DNA, 262 bp, Homo sapiens
ttaatgtcagtgaagaatgctcatactcagatccctcagagtctcagacagaattaagtgagttcgttcatgaaaaggaagttgtagatttgtcccaagagttgaaggaacgggtctctgaagatgacgaaacccagccagaaaaagggactgagttacaatttgagcatcttaattgggatccagaggaagttgcagagtggattagccagctaggcttccctcaatacaaggtatacaaaaataagatgttttgaaatca

SEQ ID NO: 31160 - DNA, 347 bp, Homo sapiens
tggccaggcctgggcatgggacatggtggtcagctggcaagtggggacctgtagggcccaggaagacagagtacatgcctcaggcaaattggccaaggccaagatccagcctcctgtgacaaaaagccaagccttcggcctcagtctgagggtaaggagatcacatgctcttgttctctgatctgtcccccaggtggcagtgacgaaagaagagactctcccggccgaggccccagtgcatggagagaaggaagaaatcaatttcctaattggtaccatatacatcaggtcaaataatttcttattttctagcctgggcaacacagcaagactctatctcaaaagaa

SEQ ID NO: 31161 - DNA, 423 bp, Homo sapiens
ttttttcttgagacggagtcttgctctgacgcccaggctggagtgcggcggcgcgatcttggctcactgcaagctccgcctcccgggttcacgccattctcctgcctcagcctcctgagtagctgggactacgggcggcccgccactgcgcccagctaattttttgtattttttactagagacagggtttcacttggtctcgatctcctgaccttgtgatccgcccacctcagcctcccataatgctgggattacaggcatgagccacagcgcccagccaataatatgctttttaaagaatactttgaggcaggagagtgagtagttatattgtaaagatcccacatataaaccagtaagaaaaactatcctaatgttatgtagatcagtatgcatggcttgagataaaacttccagtgactt

SEQ ID NO: 31162 - DNA, 478 bp, Homo sapiens
tttggggctaagacttgagtgaggggagggaatgaaccatgtggacatctgggggaagagtattctaggcagagggaacagcaagtgccaaggcccagaggtgggtcggaacagctgttggaggccagtgtagctggagcaggatgagctgggggagagtggaagggaggatggggagaggggaagggtggcaaggagatggctcaggatcttatgagccactgtagggacataggcttttactcagagggagatgggagccatggagggttctgggcaggggagggataatctgacttcattttttattttttttcgagatggagtctcgctctgtcgcccaggctggagtgtagtgatgccatctgggctcactgcaacctccgcctcccaggttcaagcgattctcctgcctcagcctcctgagtagctggaattacaggcatgtgccaccaggcccagctaatttttatatttt

SEQ ID NO: 31163 - DNA, 472 bp, Homo sapiens
tcatgttgtctcaatttttatttgacatccatgacataatctgcagactgcccagtgcctttgggtgattgaattagttttgtaagtccccagcagttgtggataaatcaaaaagacaaggaaagtgcaagatacagcagagatatcctgaagcaggcaacttcaaacagaaggaaaccacttcacatccagaggacagaggacggggtcaaactcgaaagcattttcccacccgcgttcactctactccttgaatattagttctccacatggccacagacacatctaagagagtaactccagcaaactgtctacattactagagtgttcccctcgttgaggctccccagcccctttctcccaccccagaagtttcttcatggtccccttcacatccttgttcctcaaagtgtagatgagggggttgatgctgggaatgacgatggtgtagaagagagtcaggaacttcccc

SEQ ID NO: 31164 - DNA, 433 bp, Homo sapiens
cagaatttaaaaatagatgaagcaaaatctgatagaacttaaaggagaaatagggaattcaataattataatagaaaatttccacattcttctcttacgaatagaactagtagacagaaattactaatggtatagaatgcttgaaggtggtctgggcgttgtagctcatgcctgtaatcccagcactttgggaggcctaggcaggtggatcacttgaggtcaggagttctagaccagcctggacaacatggtgaaaccccctctttactaaaaatacaaaaattagctgggtgtggtggcacgtggttgtagtcccagctactagggaagctgaggcacgagaattgcttgaacccaggaggtggagactgcagtgagccgagattgtgccactgcactccagccttggtgacaggggtgaaactctgtctca

SEQ ID NO: 31165 - DNA, 405 bp, Homo sapiens
tattgttggccataagaatacgttttttggaaagtggtatatggcagtatgtataaggtacaactgttcaacctggaaatcataggatagaaaattacaacattaaaactctgaaaattagtagattacatggatgatgtcacttaattttaaaatggaaagaacaagtgttcaaccacaggaatttgtatgaagtgcatttattaatataaaaacacaaagccagtaaaatgatgacatagatgtacaataaaaagagaagagcataatgtatgccttagggaaatcctattgtagccttcataacaaactaagtgtctttgtgtttctgggtttgtttatttggttatttttagtgtgtatgtacatcatttgtggatgaatattctgacattttccctggca

SEQ ID NO: 31166 - DNA, 1337 bp, Homo sapiens
actcagccaagtttaccataaacagaaggcagaattgtctatttttaactttacagcccttgggtgattaaaattttgagccataataaacaacttttttcttctttgcaacataatttctcatttgaaattgcagtctttttagttgtttaggagatatggattgagcacttcatgtttttaaattctttcttaaatggaaatttcttgcagagactaaatgcatgcattagcatgccaaaagcacaattttttttttttaaggaaagaaaaggaaaaaaaactcactaaggcccaaaactgaattgccttctcttctttctattttaactgtttaccaattagcacctttggccagctgcattttaggagaacatagtaacagatccgccattctgttcctgtaagtagaatggccgcaaacacctcaccatcacgggggcagattattgggcaatttggcatgtttgcatacctattatgtcagcagaaactgtatcttcccaccaggaaagacagttgcatatgcaataaaccaatagcctttgacatgtcagttaattacatcagttagccactatctcctgagcatgatcgctgtgttaatgaaactattttggtgtggaaatgaaacaggtcaagacaagtagatcaggaaatagaagggatttagggtcatatagaaagtcaatgtgctgagtcacacagaacttaaccttggccttcagaaaggatataaaatttttccctctgctgtgagtaatgttagtattcctttttcttggcatcacttcgtgctaaatagctcaaaactctttagaaattatcaagtttaacagtattgcctccccttcaagggctgttaacaatcgagttattggagataaaccaaagaccagtattataggcgctgactttaaaagacatggtttttttttccccctgagtaaaggggaccagtcaaagatgatgcccggtttctggtttggacgacagagttaagaatggtgacagctacttgttttgaaacaagatgagcagatgtattggaaaaacagatcagatattgcaaggagatgttaactcgggtttctgttggttttttcatgctgagcaggggtttgaggctctagagaaggacttaactccttcttcgatcttgtagcacatcagagactatcccacccctactttcaccagacacttaaatatttaagcttgttactgaggtcattctaagaaatctcttcttcaattttacagacatgccttcttcaactgcccgtcacataatatgatttcccaattcattggcatcgagtctccattctgttggc

SEQ ID NO: 31167 - DNA, 1400 bp, Homo sapiens
catggcttcagccagtccctccgtttggggtccctgacttcccgcaacagacaacttgagttgcatcaaactaaaaagcatctgcactgcaaagggtacagttaacagaatgaagacacgggttttgagaaaccattttcaaatcatatatctgataaggggctaatatccaaaatgtattaagaaacccaagcccaatagcaagaaaacaactgtctttaaaagggggaaaaggacctcaacttaaatttttcagaggaagacatgagtggccaattgattgatacatgaaaaaaatgctcaacatctctaatcattagtgagttgcaaatcaaaactgcaagatattaccttacaccttttagaatggctattattaaaaggatgaaagacaggtgctggcaaggatgtggataaaaggaagtcccaacattctgttagtgggaatataaattagtatagccaatttaggaaactatatggtggttccttaagaaactaaaagtacaattactatatgatctagcaatctctacttaggtatatatccaaaggaattgaagcagtatgttgagatcttgcactcccttattttgaaattatttacaaagctaataaatggaaaagacttaagttttcataacagatgaatggacatagaagatgtgttgtatatacatattggaatattttttatccttggaaaagaaggaaaattgtcatttgtgacaacatggatgaatctgtagtatactatgctaagtgttgtaagacaggcacagagaggcaaatactacattatatttgtatgtggaatctaagaaaggctaactcatacaagtagaaagttggatgttatggtttccaggatgtgggtgttggagagatgggcaaaggcaagacgttggtcaaagagtaccaattttctgttaggaggaataagttttagacatatttcacagcatggtgaccattgtcactgactgtatattttaaaattgttataagtagatattaaagttgtcacaacaaaagtaggtgaagttatggatatgttaatgtgcttgatttagttattacactatgtatacatacaaaaacatcagatagttccctggaattatatacaattattacttgtcaattataaaaaaaagccctactgcaaccactaaaaaggattttcatataatagagggaaaaatcgttaaagataataatacattattttagaaaatattaacttataaaaagtagtataggagggattctgtaaaagaagatagacatagaattttaaaatgtataatggaaaatttaaatccagctgtactgatggatcaagcaatccaaaccagtctgattgaccaagtggatatttaaaaaacaatcaaactata

SEQ ID NO: 31168 - DNA, 427 bp, Homo sapiens
aatgatgttgccattattttgattatcaaaatatcatgacaatggcaatacattgtaagtatttccatgtgccagatacgtctcctctgttatcttgatgctattttatactattttacaataaggaagcagaggctttgggggaggggacagacaatatcttgccttcattcatagagccaggaaaaacattcgggtcagattggaagacatctctgtctacattccaaaacacatattaaggaatgtcctggagctggctaccacaggcttctgagaaccaactgtggtttcccactctgccaatggtgacatcttgttggtgttttgaaattggacatggtggggatatttataccatggaaatagcaaacactacaaattggggttttttccctagagcgccagtttatcttccagtacatca

SEQ ID NO: 31169 - DNA, 442 bp, Homo sapiens
cgggctcaggccattcccccacctcagccttctgagtagctgggactacaggtgcatccaccacacctggccaacttttaaatttttagtagagacagggtcttgctatgttgcccaggctggtctcaaactcctgcccccaagcaatcctcctgccttggcctctcaaagacgtgggattataggtgtgagctattgtgcccagccagttacctctaattttttgggtgtttttttttctggcctccgatagtttcctcatgtgcatctgccgatcagtccttagctgaacacttgagtgggaaccctctgcaaacctcaggaatgtcctagcagccttggtctccccagattctctgctctgtattctcaactcatggagtttggttctacccaggttcccctttctttgtggtgtggcttgcaaactctctcaaggcag

SEQ ID NO: 31170 - DNA, 276 bp, Homo sapiens
agtcattagaatatgaagggctaatcctgaaggatacaggaccagagaaagagatcgccagattctatgtgtaaactcttctcaaacctctggttgaaaccagaaatgcacaaaggtgagacaaattgctagcaaccatattaaatccgaattactaaatgcaaatcctttgtatccaaaagctgaggttttcaaattgaatcaaacattattgattgtgtaccacaagacaaataccaacattctcaaggaataatatggaatctagagtcttaa

SEQ ID NO: 31171 - DNA, 925 bp, Homo sapiens
tttgattcttgacctgggctcttttctgaatgcagtatttaccactcatgttgccaaacaactaaacaaacaaacagacaaaaactcagttgttcaatgagtgttacaggagattttgttcttcttagttgctctggatccttctgttggccacccttgtggggctgctgctccagcggcttgcagctagactgggagtggttactgggctgcatcttgctgaagtatgtcaccgtcagtatcccaaggtgagcaatgtattgtcctgtttgtctctcacccatgccataggaatctgtgtgtctggcggtatgtgctggcctcattctatagtgagacagtcaaggacttgggggtcagtggccctgaagacagacggtaccaacggaaatactgtagctcctcctgctgccaggccatgttttccccctctttcaaaatctaacttgagactcgcatttcctagaaggttttcttagaaaaactgtgttaccattcactctggcttccagtatctagcaatgcccagcccaaggggaggaggatgctctctctaagcacttttattcatacctccatgttactccatcagtttgcattttatatatgttctttttttgtttgactttgccatcactttgaaaaagtaattttttttctttttagtacaaactatatgtggcaagatctttggatttgctaataattatttttcagtttcccctcccaccgggggctacactgtcctctgcagcttcttctggacattttgggcctttcttaccgttcctaaggcaagaatgaacactatgtctggaagatatttttaacttagttttgtctcttgttttgtttcttttcctgggtgtgagcaaaaagtatccttatctgcttttcaaaaaaataaaaaaatcttgataatatc

SEQ ID NO: 31172 - DNA, 704 bp, Homo sapiens
taaaatagtatggacaaactttgttgaggaaggcagctgattttttgaagggggagtggggttgagagaatgacttgtgcaacccttggtggtagaagatgggcacagctggatgttcaaggaagggagcaggtttgcatttgagaagtgctgtgtgagcagtcatggctcttcaaagagcctggtgagtgatgaccatgttttgtctttcagggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaact

SEQ ID NO: 31173 - DNA, 653 bp, Homo sapiens
tgggaacgttaataaaatggctcattgcgtttctaggccttgttgcatctctagggacttaaatattagggattatttgttggtgtcttttcccccctctttctccctgtctaccagtatctaactttgggtgatttaacttagacttatgaagaatcattttttttcaaattaagaacaatttttccattcattttgaactgcctctaattcccatcctgtttccttttctgtctgtggccaagttggattattccatcagtgactgtgctgatttcttttacagaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttggtaagtctagcctggaagagcaggggcataggtatcagggatggttgaggtggggttcactgacattcagaaatgaacagacccaggctgggcacagtggctcatgcctataatcccagtactttgggaggctgaggcgggaggattgcttgaatccaggagttagagaccaatctgggcaacatagtaagactccatctctacaaaaaaaga

SEQ ID NO: 31174 - DNA, 499 bp, Homo sapiens
ggaccccgacgcttaagggctacctcatttagtctctgttccctatttggggaatgtacagttcaacgaaagggcatgaagttcttttttctccccccatatgaagttcttaattgctcagtgaactaggatgtaggtgagtgttggatctctcacttttcgtctggtcaacttttgtcccctaaatctctcagctgactccaaactcctgaaatgtcacaaggaaacttgttctaactggtcaaaaagtgactgctgttgttatctttctagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggtgagtaagccagggttatgggtggtagtgaatgtgagggtaaagtgaagactgcaatgggatgggg

SEQ ID NO: 31175 - DNA, 4143 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 31176 - DNA, 4089 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 31177 - DNA, 4476 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaactggttacaactgagcttttagtaaccatttaaccgtatgtaaacttggtttctaattaaaaaaaaatttctttttccaatttggtttcctgggtatttttttaaccttgaaataatttattaatagggttacaacaactttgatacaaaaatactgaaacagcaactaccacctggaatggcacactaagtccacactgttaggattttctccttagaaaggatagagaaataaatggatttagtcctcagaaagcttggattaattgcagataccaggatattaatttccatttacccacttagtcaaatagttttaccatagctaaaggtcacatcattaccatgttgaaacttgggaaaaaaat

SEQ ID NO: 31178 - DNA, 4089 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 31179 - DNA, 4100 bp, Homo sapiens
tgcttggtggttttgctgcagcttcagagtttagcctgaactgtggcaggattttgtaacttgcacattttttgagaagtctgatggaggtataatgtccacggtcgattctttgaacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 31180 - DNA, 3938 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataagtaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaatttggtttcctgggtatttttttaaccttgaaataatttattaatagggttacaacaactttgatacaaaaatactgaaacagcaactaccacctggaatggcacactaagtccacactgttaggattttctccttagaaaggatagagaaataaatggatttagtcctcagaaagcttggattaattgcagataccaggatattaatttccatttacccacttagtcaaatagttttaccatagctaaaggtcacatcattaccatgttgaaacttgggaaaaaaat

SEQ ID NO: 31181 - DNA, 4404 bp, Homo sapiens
tctgttttaatgctggtcatttgtgtctgaattccaaagggacgggagtataatgaggtttgtctgacccctccctcccatcatggcctgaactagtttttcaggttttctttggaatgcccttggtcaagaagaggatccgttcagttggttgggggagcttagaattttatttttgtttgctctcctcagtgtcccaagtagttggactataggcacacaccacacagcaccacacctggcttgtttcctttttaaaatggtggctcttgtcctttttgggaagtgtttgggcacagaggtactgatactgttattctggttttagaataagaggctgatggaacctgcaggtaagggaagagctttgacttggacagagaagtggccagcttcttaataaaaagtgggtaagatggaggtgaaacttggacacatgcaatatctgacattgtaaatccttttttcttgtgaggctggattttgttgcttcatatgtgataacagaccaattatatcagtagttcaatggtgatgttcagtttaatctcttttcctctcttgtacagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 31182 - DNA, 4168 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagaataagaggctgatggaacctgcagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 31183 - DNA, 3124 bp, Homo sapiens
acctcttatagatgattgtgtatgatatgtaggagagctcttatttggtccttgcttctgaaacaaaagttgctgttgaattgctttgggttctaggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 31184 - DNA, 4231 bp, Homo sapiens
  misc_feature (3266)..(3266): n is a, c, g, or t
  misc_feature (3275)..(3275): n is a, c, g, or t
  misc_feature (3990)..(3990): n is a, c, g, or t
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcagtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagaggtgagttttgttcagacgttttgaacaaaaggcaaagatttcctcatgggaagggtgttcaaaactgacagctataaatgtaggtcagagacccacccacctcataacagtcatacactcccagagttaaacgattggcctctgatggccacacacccctatgggcttgtgtcttggactctgggatttaaaagatatatatgtatatatatttatgtaaacctgagcatctcagtttgggtagagttttaaggttatatgaaactgatagaacttttgtattttttttttaaatattgttttgatatatcagatatttgttttgtctggatcacaagtgagaaagaaaagagaataatgctctttttcacaatgaactggtcaaattgactatcttgtaaagtgatactttactatgtcagtgaaatttcagtttgattttagtcaaccagattatatcctttgtatctactgatattaacacatcatattaacacatcatttcttaaaaaaacatttcttctgtttggcaatcataattaactctggttatcagcctattttgtaattattgtctttgtcgtcacttttcttgaattgttttctagtcattaaacagatatgaaggcattgccaaagagctttaatatccagtaacaagatccagaaaccaaactttaaccagtgatcagttttccgtgctgcattgtaactcagctcattctggcattcaagttttaggcaaaaaaagaggaaacttctaacatttagcttgtaagtcctgacataagatagtgaagatatttatcttctttctaatatttgtatagtccgccaatgtattttcttcccactattcccattaacataccaaacactgtttctaggtccaaagtctatttctaggagtggccaatatttgtattgttgaatctcctagggaatgctaaatgtttcactttaaaatacctatttataccaagtagcatgagattagtactagagtgagatttggaatattagtccacatatcacaaactgcttgcctacatgtatagattttttttttcacccaccttcctaaccaggaatttgtttccttaaatttgttgttgttgttgttgttgtttgttgttatttttttgagaagagtcttgccctgtcgccaaggcgggaatgcattgacgtgatctcagttcactgtaacctctacctccccggtttaatcgattctcctccttcagcctcctgaatagctgggattncaggcaccncatttttagtggagatggggtttcaccatgttggccaggctggtctcaaactcttgacctcaagtgatctacctgcctcagcctcccaaagtgctgggattacaggtgtgagccactgcacccagcgttttttgttgttaagacagggtcttgctctgttgcccaggctggagtgcagtggtgtgatctcagctcactgcaacttctgccacctgggcttaagccatcctcccacttcagcatcccaaatagctgggactgcaggcacacaccaccacacccagctaatttttgtattttttgtagagacgggatttcaccatgttgcccaggctggtgttgaactcatgagctcaagtaatctgctggccttggcctcccaaagtgctgagattataggcgtgaaccactgcatccagctcactcctcatttctttctagccccaaaggtgttgagtcagcaaatcctgcagcctttgtgtgactttgagcatcactttcccctttcagcattaaatatatgacctctctgccttattttagaacttactacatttcaataaaactttttaaaaaatccagacattgcctatgttcgtttataatcggcccttaaagaggcagggatttttctaaaatgacactttaaaatttcctcatttctacttcagggcctcttgaaacttcagataatgagagcagccaaccctgcaantcaggctatagagtccttctgatcttaaaactgagactgaattcacatcagttttcgcttttacttgaaaaagagactcttaagtgttttggtttctttatacaggacaacaactctagatgaaaccagtgtgttggattttccccgcctccctgggtggttttatttctcagttgtttcattaccagagagtgttggggaaacgaaggtaaaaaataaaaacatcctgttgtgaaactca

SEQ ID NO: 31185 - DNA, 2569 bp, Homo sapiens
  misc_feature (2328)..(2328): n is a, c, g, or t
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacgtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagagagacgggatttcaccatgttgcccaggctggtgttgaactcatgagctcaagtaatctgctggccttggcctcccaaagtgctgagattataggcgtgaaccactgcatccagctcactcctcatttctttctagccccaaaggtgttgagtcagcaaatcctgcagcctttgtgtgactttgagcatcactttcccctttcagcattaaatatatgacctctctgccttattttagaacttactacatttcaataaaactttttaaaaaatccagacattgcctatgttcgtttataatcggcccttaaagaggcagggatttttctaaaatgacactttaaaatttcctcatttctacttcagggcctcttgaaacttcagataatgagagcagccaaccctgcaantcaggctatagagtccttctgatcttaaaactgagactgaattcacatcagttttcgcttttacttgaaaaagagactcttaagtgttttggtttctttatacaggacaacaactctagatgaaaccagtgtgttggattttccccgcctccctgggtggttttatttctcagttgtttcattaccagagagtgttggggaaacgaaggtaaaaaataaaaacatcctgttgtgaaactca

SEQ ID NO: 31186 - DNA, 1217 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttggtaagtctagcctggaagagcaggggcataggtatcagggatggttgaggtggggttcactgacattcagaaatgaacagacccaggctgggcacagtggctcatgcctataatcccagtactttgggaggctgaggcgggaggattgcttgaatccaggagttagagaccaatctgggcaacatagtaagactccatctctacaaaaaaaga

SEQ ID NO: 31187 - DNA, 1492 bp, Homo sapiens
tctgttttaatgctggtcatttgtgtctgaattccaaagggacgggagtataatgaggtttgtctgacccctccctcccatcatggcctgaactagtttttcaggttttctttggaatgcccttggtcaagaagaggatccgttcagttggttgggggagcttagaattttatttttgtttgctctcctcagtgtcccaagtagttggactataggcacacaccacacagcaccacacctggcttgtttcctttttaaaatggtggctcttgtcctttttgggaagtgtttgggcacagaggtactgatactgttattctggttttagaataagaggctgatggaacctgcaggtaagggaagagctttgacttggacagagaagtggccagcttcttaataaaaagtgggtaagatggaggtgaaacttggacacatgcaatatctgacattgtaaatccttttttcttgtgaggctggattttgttgcttcatatgtgataacagaccaattatatcagtagttcaatggtgatgttcagtttaatctcttttcctctcttgtacagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtgagcaatgtattgtcctgtttgtctctcacccatgccataggaatctgtgtgtctggcggtatgtgctggcctcattctatagtgagacagtcaaggacttgggggtcagtggccctgaagacagacggtaccaacggaaatactgtagctcctcctgctgccaggccatgttttccccctctttcaaaatctaacttgagactcgcatttcctagaaggttttcttagaaaaactgtgttaccattcactctggcttccagtatctagcaatgcccagcccaaggggaggaggatgctctctctaagcacttttattcatacctccatgttactccatcagtttgcattttatatatgttctttttttgtttgactttgccatcactttgaaaaagtaattttttttctttttagtacaaactatatgtggcaagatctttggatttgctaataattatttttcagtttcccctcccaccgggggctacactgtcctctgcagcttcttctggacattttgggcctttcttaccgttcctaaggcaagaatgaacactatgtctggaagatatttttaacttagttttgtctcttgttttgtttcttttcctgggtgtgagcaaaaagtatccttatctgcttttcaaaaaaataaaaaaatcttgataatatc

SEQ ID NO: 31188 - DNA, 487 bp, Homo sapiens
attaagggtacactactgtgttcactgaccatacatttttcttagcccctcaagtaataatgcttgtggtgttcgctgttcatctgagcccccaaaagcattattactgatacttgcacacagtcaaaagcgcagactggatggatggtcttttataagtaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 31189 - DNA, 780 bp, Homo sapiens
tctgttttaatgctggtcatttgtgtctgaattccaaagggacgggagtataatgaggtttgtctgacccctccctcccatcatggcctgaactagtttttcaggttttctttggaatgcccttggtcaagaagaggatccgttcagttggttgggggagcttagaattttatttttgtttgctctcctcagtgtcccaagtagttggactataggcacacaccacacagcaccacacctggcttgtttcctttttaaaatggtggctcttgtcctttttgggaagtgtttgggcacagaggtactgatactgttattctggttttagaataagaggctgatggaacctgcaggtaagggaagagctttgacttggacagagaagtggccagcttcttaataaaaagtgggtaagatggaggtgaaacttggacacatgcaatatctgacattgtaaatccttttttcttgtgaggctggattttgttgcttcatatgtgataacagaccaattatatcagtagttcaatggtgatgttcagtttaatctcttttcctctcttgtacagtactcttgttttagctttcgtaaactctgggctttcaccggaccaggttttcttatgagcattgcctacctggatccaggaaatattgaatccgatttgcagtctggagcagtggctggatttaaggtgaacatctagtcctacccctgtccttttaagcacataataccctctcacatccttttctccaccctgcatgttggatagtagc

SEQ ID NO: 31190 - DNA, 2165 bp, Homo sapiens
  misc_feature (1)..(1): n is a, c, g, or t
  misc_feature (3)..(4): n is a, c, g, or t
  misc_feature (6)..(6): n is a, c, g, or t
ngnncnggcaccatgaggaagaagcagctgaagacggaggcagctccacactgtgaactaaaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaact

SEQ ID NO: 31191 - DNA, 4432 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaatttggtttcctgggtatttttttaaccttgaaataatttattaatagggttacaacaactttgatacaaaaatactgaaacagcaactaccacctggaatggcacactaagtccacactgttaggattttctccttagaaaggatagagaaataaatggatttagtcctcagaaagcttggattaattgcagataccaggatattaatttccatttacccacttagtcaaatagttttaccatagctaaaggtcacatcattaccatgttgaaacttgggaaaaaaat

SEQ ID NO: 31192 - DNA, 4096 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaataaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 31193 - DNA, 4117 bp, Homo sapiens
  misc_feature (1)..(1): n is a, c, g, or t
  misc_feature (3)..(4): n is a, c, g, or t
  misc_feature (6)..(6): n is a, c, g, or t
ngnncnggcaccatgaggaagaagcagctgaagacggaggcagctccacactgtgaactaaaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 31194 - DNA, 4063 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 31195 - DNA, 3447 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 31196 - DNA, 4149 bp, Homo sapiens
  misc_feature (3184)..(3184): n is a, c, g, or t
  misc_feature (3193)..(3193): n is a, c, g, or t
  misc_feature (3908)..(3908): n is a, c, g, or t
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacgtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagaggtgagttttgttcagacgttttgaacaaaaggcaaagatttcctcatgggaagggtgttcaaaactgacagctataaatgtaggtcagagacccacccacctcataacagtcatacactcccagagttaaacgattggcctctgatggccacacacccctatgggcttgtgtcttggactctgggatttaaaagatatatatgtatatatatttatgtaaacctgagcatctcagtttgggtagagttttaaggttatatgaaactgatagaacttttgtattttttttttaaatattgttttgatatatcagatatttgttttgtctggatcacaagtgagaaagaaaagagaataatgctctttttcacaatgaactggtcaaattgactatcttgtaaagtgatactttactatgtcagtgaaatttcagtttgattttagtcaaccagattatatcctttgtatctactgatattaacacatcatattaacacatcatttcttaaaaaaacatttcttctgtttggcaatcataattaactctggttatcagcctattttgtaattattgtctttgtcgtcacttttcttgaattgttttctagtcattaaacagatatgaaggcattgccaaagagctttaatatccagtaacaagatccagaaaccaaactttaaccagtgatcagttttccgtgctgcattgtaactcagctcattctggcattcaagttttaggcaaaaaaagaggaaacttctaacatttagcttgtaagtcctgacataagatagtgaagatatttatcttctttctaatatttgtatagtccgccaatgtattttcttcccactattcccattaacataccaaacactgtttctaggtccaaagtctatttctaggagtggccaatatttgtattgttgaatctcctagggaatgctaaatgtttcactttaaaatacctatttataccaagtagcatgagattagtactagagtgagatttggaatattagtccacatatcacaaactgcttgcctacatgtatagattttttttttcacccaccttcctaaccaggaatttgtttccttaaatttgttgttgttgttgttgttgtttgttgttatttttttgagaagagtcttgccctgtcgccaaggcgggaatgcattgacgtgatctcagttcactgtaacctctacctccccggtttaatcgattctcctccttcagcctcctgaatagctgggattncaggcaccncatttttagtggagatggggtttcaccatgttggccaggctggtctcaaactcttgacctcaagtgatctacctgcctcagcctcccaaagtgctgggattacaggtgtgagccactgcacccagcgttttttgttgttaagacagggtcttgctctgttgcccaggctggagtgcagtggtgtgatctcagctcactgcaacttctgccacctgggcttaagccatcctcccacttcagcatcccaaatagctgggactgcaggcacacaccaccacacccagctaatttttgtattttttgtagagacgggatttcaccatgttgcccaggctggtgttgaactcatgagctcaagtaatctgctggccttggcctcccaaagtgctgagattataggcgtgaaccactgcatccagctcactcctcatttctttctagccccaaaggtgttgagtcagcaaatcctgcagcctttgtgtgactttgagcatcactttcccctttcagcattaaatatatgacctctctgccttattttagaacttactacatttcaataaaactttttaaaaaatccagacattgcctatgttcgtttataatcggcccttaaagaggcagggatttttctaaaatgacactttaaaatttcctcatttctacttcagggcctcttgaaacttcagataatgagagcagccaaccctgcaantcaggctatagagtccttctgatcttaaaactgagactgaattcacatcagttttcgcttttacttgaaaaagagactcttaagtgttttggtttctttatacaggacaacaactctagatgaaaccagtgtgttggattttccccgcctccctgggtggttttatttctcagttgtttcattaccagagagtgttggggaaacgaaggtaaaaaataaaaacatcctgttgtgaaactca

SEQ ID NO: 31197 - DNA, 3156 bp, Homo sapiens
gcagagaaacgaaggagcatccagtaaagtttagactgaaagcttctggaatgaggtccggacttgagcctagcttctggcacagtgcccagcacagcacttggtgttggtggtgcatagcaaagaagggagaaatgccacagggaactgctgttttggatattgtctgagcagattattgccacaatcatatccttcctcttggcctctcacagggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 31198 - DNA, 2191 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaact

SEQ ID NO: 31199 - DNA, 2055 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacgtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagaggacaacaactctagatgaaaccagtgtgttggattttccccgcctccctgggtggttttatttctcagttgtttcattaccagagagtgttggggaaacgaaggtaaaaaataaaaacatcctgttgtgaaactca

SEQ ID NO: 31200 - DNA, 480 bp, Homo sapiens
cggacgcgtgggtcgacccacgcgtctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttgccacctcgatactcggtccagcgcc

SEQ ID NO: 31201 - DNA, 422 bp, Homo sapiens
ctgcttacgtaagcagctaaaggaaagcagccctaatgaattggtatcccatttcagttattgttaaaatatacaccatgacattcaatattcagtgttttttgaaatggtttaagcataactctttaataagatcttaaatgcccattcttatttaaagtcatttttggttttcacactaaattacgctttttttccctttacttttgcatctattaactctattccttaaattattattatttttacttttgtttctcaaggagttatctcaattttgaggaatcatgctggggcaaggattgcagttgaagtattttgcttttggagtgtataatagtatgaataattttgtgatgttttggggtttggattactttgggaagatctgtgtcattaaacatcataaaaagaattcccat

SEQ ID NO: 31202 - DNA, 456 bp, Homo sapiens
ctatagactgagcaccgaggaatcagttgtggaggaggtgtgacttaaactgggatatgggcagaagttgcataaggcttgtggccagtagctgagccagactccaatcccatgtccttttaatactatgacctctatcacatctatgagtttaaaagacaaaacaccgggcgcggtggctcatgcctgtaatcccagcactttgggaggctgaggtgggtggatcacctgaggtcgggagttcgagaccagcctgaccaacatggagaaaccccgtctctactaaaaatacaaaattagccgggcgtggtggcacatgcctgtaatcccagttactagggaggctgaggcaggagaatcacttgaacctgggaggcagaggttgcagtgagccgagatcgtgccattgcactccagcctgggcaacaagagcaaaactctatctcaaaaaaaaaa

SEQ ID NO: 31203 - DNA, 278 bp, Homo sapiens
aggcgtggcctgtgtggtgcttttggcacttacacgtggtcttgtctggccagttgtctggtcctgtcggtttctgcctttcctctttctccagggaaaacctaagctttccttgtttgtcctcatcttgtgtttttctgggtccatgggcagagtagagttctggaacggtttcctaaagcagacaaaccctacccattgttttttttttgttgttgttgttttttgagacagagtctcgcactgttgccaagctggtgtgcagtggtgcagtctcg

SEQ ID NO: 31204 - DNA, 397 bp, Homo sapiens
ttatggtattttgattccatttacatagttttaatttttatgcagttaagtgttcgacatcttccttcacggctcctgggaatgaaaatatttacacagtgcattttgtgcaggctttccacacattatcatagttaattctcacagcagccttggaagcgaggcagggtgggaatttttagcttcagttccattttaaggatgagttcaaatgagtctcagaaaagtcgtgggacttgcccaggtccaacagattctaaaacctttgtcattctcacttcctcacctgccttccaaccagccaggtgacctactcctggcactgacaacaaaagtatatggcttctcagggactgcatttttaaatattaaaactacaagcatcttatcttccctt

SEQ ID NO: 31205 - DNA, 3192 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31206 - DNA, 1976 bp, Homo sapiens
aagacaacgcacaaaaaactgacaactagataggtacgaggccggtgtttgagctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaa

SEQ ID NO: 31207 - DNA, 3306 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtaggattccccgcctgtcattccctagcccagctcttgggaaactgcagaggggtccagaggatttgcagttctgaacctgcacactccagtctaggatctccgagcaagagcgtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31208 - DNA, 3191 bp, Homo sapiens
ggaggctcctgtggtcctgccctggtctgagatcttggagcccttcttgaagagagggtgtccgcagagttgctgatcttcctgcccctgggggctactcttgcccagggttgggcaaagcagagtagctgggagtgtaaggagaggaccctcgtcccctcaccaacctcatcctctctccccctacccacagggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31209 - DNA, 3043 bp, Homo sapiens
tgcgtaggcgacggcgcttgcgtcgtacttggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31210 - DNA, 3357 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcagtgagtccaggcccctggaggctggggagcagctccacatgttgagcccagtcgagttcagtgtggccgtaggcaggccctggagctctgggccagctgcacagccagagagagcccttgagggagggattaggggagtgtgacccttccttccttccttgtcagcttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31211 - DNA, 1920 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacgggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaa

SEQ ID NO: 31212 - DNA, 3560 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcagtgagtccaggcccctggaggctggggagcagctccacatgttgagcccagtcgagttcagtgtggccgtaggcaggccctggagctctgggccagctgcacagccagagagagcccttgagggagggattaggggagtgtgacccttccttccttccttgtcagcttccagctcttctgatgagctcagttggatcattgagctgctggagaaggatggcatggccttccaggaggccctagacccagggccctttggtgagaacccgttttctccttccttccccagcctgtcttgtcccatccctgcccctccacagagtgctagagatgaccccctccccagacttcttcctccctcaattagaaaaattgcagcaggtcatcagacccatgggcagcatcacctgtcctggtctggtcccctgagccctctctgagttctcacctcctcttcccagaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31213 - DNA, 3153 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31214 - DNA, 2427 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaaaaaaaaaaaaaaaaaaaaaaaaaaaaaaaaaaaaaaaaaaaaaaagaggggggggggggcatagaaaggattcccgggggggggcaaaagtttgggcgggtaccccagttttttgggtgacaaggggggcccccaataaggggggggggtaataattaagcaagaggcaagggaggacggcagtagttaacacaacgtgctcggaggggggaaacaacggtgtaatcagaggcggaatatttgggagggaggaaaccacaatctcggtgggggggggaccataatggtgggcaacaatccccagggggaatattaagagcctagagggggaaaatatacatcttaggggtttaagtggtgtgcacacagcgcaatagtttggggcctaaaaaattggccctggggaattgattagcatcatttttg

SEQ ID NO: 31215 - DNA, 2438 bp, Homo sapiens
tcccgtgcttgggatcccccttcttgcagtcacgaaaaccatcgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31216 - DNA, 2235 bp, Homo sapiens
tgggtgagaggggacacctggatggcaaactgatggaggctggccttgcagcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31217 - DNA, 1941 bp, Homo sapiens
gatgctatgactgcgagaaggagagagaccgcgagagtaaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31218 - DNA, 1600 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagccgcgtagtctctcgagccgcgtagtagccgcgtagtctcatcg

SEQ ID NO: 31219 - DNA, 1035 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgagcctggcttggtggtcctggagagga

SEQ ID NO: 31220 - DNA, 914 bp, Homo sapiens
  misc_feature (905)..(905): n is a, c, g, or t
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgttcccccccccccnaaaaaggcc

SEQ ID NO: 31221 - DNA, 695 bp, Homo sapiens
  misc_feature (695)..(695): n is a, c, g, or t
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcaccttcacaagccactatctagaatgacgccacaagtttggattcaatttgaagctagcttggaagaaaggataggcattgggcctttccaaggaaggcccctaagan

SEQ ID NO: 31222 - DNA, 194 bp, Homo sapiens
catccaatgagacaccagctcaggttactgcaggggacacactataaagccctgagctcagggaggagctccctccaggctctagctctatttagagccgggtaggggagcgcagcggccagatacctcagcgctacctggcggaactggatttctctcccgcctgccggcctgcctgccacagccggactccg

SEQ ID NO: 31223 - DNA, 2001 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaa

SEQ ID NO: 31224 - DNA, 3337 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcggtgagtcgagggaggtccccaagagggcgtcccatttagcaatgcacagggggcccggctcttcctgcagccttttcctgtagaggggctactctccctaactcccctcttgcccctccttgaccttccaccaccgtccccacagatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31225 - DNA, 3027 bp, Homo sapiens
  misc_feature (8)..(8): n is a, c, g, or t
  misc_feature (14)..(14): n is a, c, g, or t
  misc_feature (29)..(29): n is a, c, g, or t
ggcacgcnctcgtncgaattcggcacgantgtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31226 - DNA, 3186 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccgagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcagtgagtccaggcccctggaggctggggagcagctccacatgttgagcccagtcgagttcagtgtggccgtaggcaggccctggagctctgggccagctgcacagccagagagagcccttgagggagggattaggggagtgtgacccttccttccttccttgtcagcttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31227 - DNA, 3431 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcaggaacaggaacaggctgggaagtgtgtcctgagagccagcagcgtggttgagcagagggtgggccggcaggggacttactctgaccccgccccccggactggtgcttctcggagctcccactcctcagactccggtggaagtgacgtggacctggatcccactgatggcaagctcttccccagcggtgagtcgagggaggtccccaagagggcgtcccatttagcaatgcacagggggcccggctcttcctgcagccttttcctgtagaggggctactctccctaactcccctcttgcccctccttgaccttccaccaccgtccccacagatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31228 - DNA, 1990 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgattgctgccaacacaggcctgttcataatgaaaggt

SEQ ID NO: 31229 - DNA, 2204 bp, Homo sapiens
atttcttcgcatattctctccgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 31230 - DNA, 1314 bp, Homo sapiens
  misc_feature (1268)..(1269): n is a, c, g, or t
  misc_feature (1271)..(1271): n is a, c, g, or t
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccccggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggatgtcccggatgaactcccacaggtgggtgcctctgggcgcagctgcctcctcacattgaggnntnccagaggcaggacagtgccaattgggatcctctagaacagcca

SEQ ID NO: 31231 - DNA, 944 bp, Homo sapiens
gagagagagagagagagagaactagtctcgaggtcgacgcggccgcgaattcgcggccgcgtcgaccgaagacgcaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacaggtgggtctcagcggggtgggatggggcacggagtgggagacagatccatctaagggcctgttagacaaatgggggaataggcagggaggagggtctctaggcaaattccagggctagaggctgagacttagtgactgaggtgctgggggttgtggggctgtgacaggcagagggaggtgtcagataccaggacaagggtgttgtgaatgctacctcctgcccctactcttgggatggctccaagggctgaggtgtgaatccccagtgtgctccaggaatggggctgtgtgggctgggagtggtggctcacgcctgtaatcccagcactttgggaggctgagctgagcggatcacctgaggtcaagagttcgagaccagcctagccaacatggtgaaaccccgtctctactaaaaatacaaaaaaaaatttatcccagcgtggtggtgggcacctataatcccagctactggggaggctgacgcaggagtatcgcttgaacctgggaggtggaggttgctgtgagccgagattgtgccattgcaccccagcctaggtgacaggagtgagactccatctc

SEQ ID NO: 31232 - DNA, 445 bp, Homo sapiens
ttcttttctttttttaatagtagccatcctaatgggtgtggtattgcatcttggttttgatttgttattcctgctttctgtccatatattttttcttttttttaagtgacagggtcttgctctgttgtcctggctggagtgcaatggcaccatcatggctcactgcagccttgacctcccaggttcaagtaatcctcccatcttagcctcccgagtagctaggactacaggcacacatcaccatacccagctaaatttaaaaaaaaaatttttttttggccgggtgcggtggctcatgcctgtaatccaagcactttgggaggccaaggtgggcagatcacctgaggtcaggagttggagacctgggaggcggaggttgtggtgagctgagatcacgccactgcactccagcctgggtaacaagagcaaaactccctctcaaaat

SEQ ID NO: 31233 - DNA, 1752 bp, Homo sapiens
cgcatttaggtctctcatctatttcaagttaatttttgtgtgtgatctgaggtccttctcattttgtactgagtcaaactgaagagccccccacctccccagttggcctgccacactttgccttctgcatttgggtctcagctcaaacatcctcactccagggaggcctcccctgtcaatctaaagcagctgcctccctgcagtttcagtcaccaccccattttattggggccgtcagaaatggtctgacatgttgtctgttgcctcccatataagctccatgacaacagaccctgtctagcttactgccttcgtttctagcacctagcgcagtgcctgacacttagccagagctcagactattatttgaaagcttcttttggttaaaagaaacattcccagtggattttgcttaagactttgtaagtgtctctggcctcatggagttggagggctgagtgggaggggatctaccagcatcacagtcacaggtggtcactcgtcccttgccccagccatcccattacttcacaagacagccccttccatccttggacaactctgatgattagaaaattcttcctgatgttggacagagacctgcttccccatcgctggcactcgttatccactgccttcctttagggacaactggagttgaacttcacattttgacagtcctttaaatatttgaaaccagctatcgtatgtctcttaaatacctcctctgggctgagtgcttctaattctctcagctgttcctcctggagccgagaagggctggactctgaccccttagtcgctgatgaaggcctgcagacatggggtgggcacaggctgccaaagaaagccccagcacagccacagctcagaacgaaggaactcgagtctccttgtttgctttccccactttgagctgatgaattccaaaactggaagcagaactttgagaaaaagcacccagtacaaactccctaactagatatcttaaaggcagagctgactcttagtagtacaaattactctgtaatattgctttctattaaaagggtgtggttttttttttgttgttttttttttttttttagctagtccagtggtctttttgatgttggttcagcttagtggttctcaaccctggaacaacccgtagacccacctggggagctcttaaaattatcagtgcctaccccaccttccaagattctgatttaaatcctgtagtgtttttaaggcaccccaggtgattgtaatgtacagccagggttgtagaccttggcttcaagagctcagcattgaacctgaaattccctacagccccacaagaatgagcaaatgctggatgtcagcacaacatccaggagctggcatgagccagaggactggctaagaggactcaattattttctaagatggagattatgaaagctatacatgttcaaaagaaatgaaataatatagaaatgttggccaggcacggtggcccacacctgtaatcccagtactttgggaggctgaggcaggaggattgcttgaggcctagagtttgagaccagcctgggcaacatagcaagaccccatctctacaaaaaaattaaaaaattatccaagcatggtggcacatgccgatagtcccagctactggggaggctgagcggggaggacttcttgagcccaggaggtcagggctgcattgagctatgattgtgccactgcactccagcctgggcaagagagcgagactctgtctct

SEQ ID NO: 31234 - DNA, 1314 bp, Homo sapiens
caacgatggtcctcagtagggctgaggctgcggcctctgctttttttccaccagcagccacactaagcgagcccccagttgaggggaggttcgacagctcatctgttaggctaagtcccagctcatccagaacccgggacaccacagcatcactctcctcttcatcttccccatcgctggcactcgttatccactgccttcctttagggacaactggagttgaacttcacattttgacagtcctttaaatatttgaaaccagctatcgtatgtctcttaaatacctcctctgggctgagtgcttctaattctctcagctgttcctcctggagccgagaagggctggactctgaccccttagtcgctgatgaaggcctgcagacatggggtgggcacaggctgccaaagaaagccccagcacagccacagctcagaacgaaggaactcgagtctccttgtttgctttccccactttgagctgatgaattccaaaactggaagcagaactttgagaaaaagcacccagtacaaactccctaactagatatcttaaaggcagagctgactcttagtagtacaaattactctgtaatattgctttctattaaaagggtgtggttttttttttgttgttttttttttttttttagctagtccagtggtctttttgatgttggttcagcttagtggttctcaaccctggaacaacccgtagacccacctggggagctcttaaaattatcagtgcctaccccaccttccaagattctgatttaaatcctgtagtgtttttaaggcaccccaggtgattgtaatgtacagccagggttgtagaccttggcttcaagagctcagcattgaacctgaaattccctacagccccacaagaatgagcaaatgctggatgtcagcacaacatccaggagctggcatgagccagaggactggctaagaggactcaattattttctaagatggagattatgaaagctatacatgttcaaaagaaatgaaataatatagaaatgttggccaggcacggtggcccacacctgtaatcccagtactttgggaggctgaggcaggaggattgcttgaggcctagagtttgagaccagcctgggcaacatagcaagaccccatctctacaaaaaaattaaaaaattatccaagcatggtggcacatgccgatagtcccagctactggggaggctgagcggggaggacttcttgagcccaggaggtcagggctgcattgagctatgattgtgccactgcactccagcctgggcaagagagcgagactctgtctct

SEQ ID NO: 31235 - DNA, 1661 bp, Homo sapiens
gttaaaatatgcctaaatttcctctttgggaacgcaagacttgcagagatgactccatggagagcggactctgccggcgggaactggagtcgttggtgacgtcatcccagtctgatctgtgaagggtagggccagcaggcagcaccaaagttcccgtatgcgcgttttcagtcttcatttaggtccgaattcccggcatataagaatactaccgtcgcttgtttttcagatttttgcggctattttcgttggtgtgttggtcatgtctggtcgcggcaaaggcggaaagggactgggtaaaggaggcgctaagcgtcaccgtaaggtcctgcgagataacatccagggcattaccaagcctgccatccggcgccttgctcgtcgcgggggtgtcaagcgcatttctggtctcatctacgaggagactcgcggggttctgaaggtgtttctggaaaacgtgattcgtgatgctgtgacttacacggagcacgccaaacgcaagacagtgacagcgatggatgtggtctacgcgctgaagagacagggacgcactctttacggcttcggcggctaatgctaccgcttaaacgactcagcatctcgacttcccaaatcaaaggcccttttcagggccgcccacagttttccgcaaaagagctcatgacttgttagacgattggttggtctctttataagttaattgttcctgtcaacaggtacgtatatttttcagccgttttttttttttcgttccaaattacatttggggtttcggcatacgattttttaggctacgatccttttatgtttatggtagtagggccttagattgcactgaaaaggctagggtaatagtgtctgtttaccttaccacttttatttggagtacctaaaaatgcatggttttcgacataagtgggaaaaccgcaagacactgcgtaaccgctcaaaatggcggagagcgaagaacaaagccggtgcctggcaatgggccggacccgcgaattagcgcaaccaatcatcttcctggaaaggagtgtgggccttaaattctagcggcctgttttctattacttaacctaacgaccgagtttaggtgtgtagaagttcctggggtagataagctcacgcaaggagaggttgcaagcattcatttcggaattctattaagccaacccagttgtcccttagaagttatgatatttgctgttttttgaataaaagaatttgactctctttaaaccctaaagcttgaaatttagcatttatctcacatgagacaaatgtttaggaactcatgtttaggaactcatgttcctgcctgaggcaggaactgaaacaccagatcacttgcatcgagaccgtgagactccctatgtttcatccatcatgattgcgtccttatccctccctgatttcctgttttctcgcccttctcgctacataagccccccaattttggtcggggagacggatttgtgatttcatctcctccctcatgaatactcatagaatttttccaaacctactgaatctgtatgtaaggttgactctgtaaggcatatatatattccagctccccttcactgccacagagcgctcattccatcctgggattacttctccctctgaaaataaagtctttgttacttcctgaaaaa

SEQ ID NO: 31236 - DNA, 2276 bp, Homo sapiens
ctttaaggttggtgacgccatggaaggaaaacaagtaactttgcaacaatctgttcaacaatgagagttaccaaatgccagacactgctaagtgctgggaacttagatgtaaccaaagacttaaaagatactagtctttaagacaggctttgagaaattcaagtgtagggtaaggccacctccccagcaagtaaatactgacatggtgaagatatgtattgggtgatatgagagcccataggagagacatctaaagtttaatagcaacactaggctggactgagtggtgaatacgttgatatagcaatttaataaatgtgttattgtcaatgtaggcattttgctcatagcttagggcaagtgataaaaaacagagcttaacaaaggactggatgttttagtttgacagcagtgtctaaattacagattagagaactaatgactagccataccgaagacatttatctggaaatgccttccctaagtgccaacagagaatgaaaatatagtcaatagctttaagtgaccccatgcatcttaatgcctttcaagcaacatgtttttctgacttccaaatataaacaacctaagcattgtgcagtagccatgagggactaggtatccaagtgcacattatattggctttgtaggagccattgggaggggagtaatagtttcagagtcatggaaacaaatcataagtagctgctctgggtgctctctaggagggcagaacttgctgaatttgaagactattaatgatgcagctctcactggtacaagtgaaaaacctctcagccctacacagcatctttaagaaagctttaattttggtttttcagagcaatattcacatgacatctttcggatctggaatcttaattaccattaggttggaactctacctgaactaaaaataagtggtctctatcacgttgaaattactttaatattttcatttatgtttatactatttatttaaatgcggagaacatggctaaccattcaggaccatttaattatcaaattattaatgattcttccataataaacaagcaaactgtcatacttgttgacttatatttcattccatggaattcaaatttaattaattgataaatcacattgtactttataagagtttattccttaagtgtttgaatttacacttttttctcctgtgacagcatctattcccaaggcaatcaacattttaatggaacgaactgaggtttgcaattgctaatgttattctcccatcccagtttctacttgtttcttgtaaaaaaggaggtttctaaatcttgactgttgattgacaattaatgggctaaatttcccattagcaaacacttttcacatatacactaatattagtatctaaattatattaaaatctaatttggtagcaattgacttgaaatttgtgatacttcaacttgtgctaggttgtagttttgcttgtatcactcatagttactaaaaatgcaaaaggcaaatttgaaataactataaaaataaacctttaatgaactttttaatatgcaatactcaattgtaaataaccattatctttactgaatcagatgtttcattaactgttagcagttatttcgagttatttatatatcacagaattttgaactaaagatcatctagctgaatttcctttatattaaagaagaggagaaaatcttaatactaagtatgtgtgagcctggagctgccatggagcatgtagagagagtctcctagttgataccaactcaggaaagcagaatcaagcaataaagagacattttgggcctgatgacatcatttcagcacctggatccagcgatgcctaaagatgtgactcctagacttttcacttacatgagccaaaacggttcctttgcatcaataaatcgctctgtgatgcattttataatgtacaaccaagaatctcaatatttattattttgcattaaatatcagtaagtttgatataaaaagctcagtaaaattcattaatttgagaatgtgtctatatcatagtaaagttttaaacctacataattttcaatatttataccttttactgcaaaaataaaaatgagtttatccttgccctaaagctgtaaaattaaactctgtacaattctagttatttgaaatataaaataaaattattggtcatttcatgtatacatttgtggtaacactttaactttttccctgtaaggccatcttttgtatgtttctgtttccatcaagcaggcttttaatgcaacttt

SEQ ID NO: 31237 - DNA, 983 bp, Homo sapiens
gatactcctcggccttaattagctcaggtagacagaatgtgggcaagtagttagggcgaggagaatgacaatgaaaataagtaaaactgttccttgagtttgctttgagagatacccagaactgacatttcagacactcgcatttttaaaaattaatgttttctcacctttgtgttctaaaagtcccttctatttattgtatctcagaatttaattcttcacttttttacatgtgtttttgtttatagcttctgctggcactataggaagggtaaacaactatttactgatggtgcttccaattttgctgttacatgactcaaacaaactgggttttatgagatctttttagaaaaatactaataaattattcattttcaaatattatctctaatagtgtgcataggatcttaatatggccacactttggttacataagtcatgattaagcagaatatacagtggccacatagtaggtataataacttgatactgcttttttgtaagataataagataaaaaacaattacataatattaattattggactaaaatgacatctttttaatatacattcatcatatagacttttttcataggcaagggtattatgcattttatagcccactgattattccattagacacaaaataaaatctttgaaacatgcaaaatgaaatacttttgagactagagtatcgttgctctatcagtcgtttgtttttactaaatagaagcaaaaaaagactatctgattgctttcataaatgtgtgctctttttcttgtacattacaggaaaatgaaaaaataatcattaaaaaaaggattctaaaaactttgttcctcaccttgcgtcataattttgtttgtttcagctcaccgaatatttatgctgtgttcttctggcggtgcattacaagtaccatatacaaggaaagtacggtgcaataaggtaggtaacatcagcgcatacatttggcct

SEQ ID NO: 31238 - DNA, 297 bp, Homo sapiens
ttttactaaatagaagcaaaaaaagactatctgattgctttcataaatgtgtgctctttttcttgtacattacaggaaaatgaaaaaataatcattaaaaaaaggattctaaaaactttgttcctcaccttgcgtcataattttgtttgtttctttcatgactattgttttgttttctttgcggtcattttagaaccattaaagaagtacgagcaataggtagggccaatgcaaaccctaccattgctggttgtaaactataaaatatatggcaaataaagtgttaattaaaaatca

SEQ ID NO: 31239 - DNA, 181 bp, Homo sapiens
gacctcccacccgtctccacacacagaggctccggctccttccggaaggactgcctggattttcggggcaggtgctgtgtccctccctgacactggggctcccctgcattttggccatcagctgcccacggcccccttccttctcatgggcacctgggacaagtgaggggcacaggtggat

SEQ ID NO: 31240 - DNA, 426 bp, Homo sapiens
agactgcctatgtagcaatggtcagaaaagattaaaaaacagcccttggaccatccttcattatgtatttgtgatgataatattaatttatttaaaatgatatttaatgacaaattatgtctgggaagtttgatgaacaaattccaggcaatggcttacttctgtccttttatttgtatatcttgataaatgagatgtgaattttaaaaatcttgcgtcaaatatttctagttacttaatgctgatagctaagaagataacttctactaatgaagataattaataaagcattctaattaagaaaacttgaaatagctaaattaaggaaaagggtaaggccactggctcaaacttggaaaatatatgggtaaaatcttaagacattttccttgtattaaaacaggtgagttttctgaagccatgtaa

SEQ ID NO: 31241 - DNA, 239 bp, Homo sapiens
ggcaggctagagaagctgtcccaagagcagtgacatctgaactgagttttgaaggatgaataggagtttgccaggtagacaatggatggagtgtgttcctatcaggaggaaccgcaagtttaaaatacaacagcaagtgatgtattaatagaatgactgttatgtggagtggaagcgggagggagatgtttagatggggcctatgggaaaaagtggggccaaggcatgaagggtcgacg

SEQ ID NO: 31242 - DNA, 333 bp, Homo sapiens
gccagaggagagacagtacttctgtcagtggatacctggagggtcaagctgcgggaaaggagagggactcttacaaggccagtgagctttgaccagatgagcttaccctcaggtatcctgatcacgtggagactggccatatggcttcccagaccaaaataactcacctgtgcctgtgaaaccataccagggccagatgcagctgcactgttgagatttgaagcgtggtgctgttgaattcaagctgctgcatcagtcaggtttctttgccagctttctatccgagcctggggtgaccatatcattcatcttccaaactaggacacgtttaat

SEQ ID NO: 31243 - DNA, 1150 bp, Homo sapiens
cgaaaaacaaacaaacaaacaaaaaaacagttcaaaagacacagaatggactggtggcgatggcccacgcctgtaatcccagcactttgggaagccaaagcggaaggatcgcttgaagtcaggagaacagcctgggcagcatagtgagacctcgtttctacttaaaacaaaaacaaacaaacaaacaaaaaaaaaaaaaaaaaaaaaaaaaggcacggggtgtgttaaaactcggggcattaaggggtggggttattcccttacgtgtgtgtaaccttgtggggaaaattttctctgtgggttccctttccaatttggggttttccaaaggggggtgtgtaccccatgtgggtaacctttttccttctttacacccacttgtgggggggggcctttccccggggtcttccaccaaaaatctttttctctttttaaaacgcaagggtgcgcctaatctgagggtggtctcccacagtgggcccaacatttgtgggcgacaaaaaaatataatggaaagggtgggcagaggcgcgcccaaacggccgtgtggtaatccccaaacaactttgtgggggagaggccccaaagaggggaccgagaactcaacggggggaggctcgagaagttgtggaaaaccagagcgggggcccaaacgggtgttaaaacccccaattcttttacttaaaaaattccccaacacgacatgggtctccaaaaaattttgttctccttcgaccgttaccatcacgtgcggggcggtctcccaaccgggtggagaaaatccggggggaaacccctttgttcacagcccaccttctgtggggggcgcctccaaggaagtgcgtccgcggtttgggtccaaggttcccgcgttaacgttgcccctggttattagagggggggccctttgtaaaaccacacaacataaggggcgcctaacacgcaaaacaatagaaaagcggggcgacgcgaaaaaaggacccacagaggggcgaaggttaagatacacccggtttttggacaaggggcgcaaaagaaggagttaaaacagaagcaaggcggcgcgttacaaacggcgcagggaaaacgacatagggcatcgggagacaacacttcgtgggagaaacgggaccccacagaatactcgcaa

SEQ ID NO: 31244 - DNA, 341 bp, Homo sapiens
cgaaaaacaaacaaacaaacaaaaaaacagttcaaaagacacagaatggactggtggcgatggcccacgcctgtaatcccagcactttgggaagccaaagcggaaggatcgcttgaagtcaggagaacagcctgggcagcatagtgagacctcgtttctacttaaaacaaaaacaaacaaacaaacaaaaaaacaacaggtgtggtgacttagacctgtggtcccagctactcaggaggctgagatgggaggatcacttgggccccagccgttgaggactgcagtgacctatgatcgcaccactgctctccatcctgggtgacagagtgagaccctgtctc

SEQ ID NO: 31245 - DNA, 154 bp, Homo sapiens
ggctatggaaagaatcactggaaaaaaattaggtggactaatttcctgagctcataccaggacagaaagagtttctgttcccacaagacaaggtggaaagacctcctaatacatgggacatcaggtagtatcctcagaagactactgtctgatg

SEQ ID NO: 31246 - DNA, 370 bp, Homo sapiens
ataataataataataataataataataataataaatacatggtgaagactgaggactgtagacactacacgtggaactttgtactcatttgcaaagaccttaggacaaaaaggtctgacttgtgtgtatatactttgccacttagcaaaaaggaatgccagtagggaaaggaaattaaggaacttgaatgaccccagcaactataaaggagtgtgctctggttttgggcacctgtagtcccatctgcttaggaagctgaggcaggaggactgcttgagcccatgagtttgaggctgtcctgcgcaatgatcacacctgtgaatacacactgcactccagcctgagcaacatagcaagacactgtctctta

SEQ ID NO: 31247 - DNA, 546 bp, Homo sapiens
gaaatacaaattgaaatgaatcaccatcaaacaaaaaaaaagggatggcattttgttactcatgaaattggcaaatttttttttaaatgataatatccagtgatggtaaggttgtgggaaaacaagaaatttcataggatactttggtaagttgatatgactttctggagggcaatttgtcagtgcagatgaaaagtcttcccattttaaagatgggaaacttaaggcctaagaatctaagtgacttgcttaaagttacaaagtcatggctgggcgcagtggctcacacctgtaatcccaacactttggggggccgaggagggcagatcatgaggtcaggagttcgagaccatcctggccaacatggtgaaactccgtctctactaaaaatacaaaaattagctgggcatggtggtgtgcgcctgtagtcccaggtactcaggaggctgaggcaggagaattgcttgaacctgggaggcagaggttgcagtgatctgagatcatgccactgcactccagcttggcggcagagtgaaactctgtctc

SEQ ID NO: 31248 - DNA, 432 bp, Homo sapiens
gtatacagtcacatgagggtgttgctaggttctgaaggggggattaaagttggctctcatagtcaaaggattctcataagcaatgccttttcattccctcccagatcatggcagagggaatcagggaagcagtaatggaaccccaattgagtgtcctgattttgtttctagtgaactgggtggaaccctctactcccctagaatactattaataaattttttattctacttgcatttgccttgcaaggagaaaagggaagaaaagaaaggagagaaaggctaaaggaaattcacatgcgattcacaattcttcattcctgccaagaacctgtcactgaagtatgtctggggctgccagggctcacatttactcagcattcatgctctaattatttccacatgtagttcaaggaaaatggttgatcaaaagtt

SEQ ID NO: 31249 - DNA, 948 bp, Homo sapiens
atggagccagaagctgggaccaataggaccgctgttgctgagttcattctactgggcctagtgcaaacagaagagatgcagccagttgtctttgtgctcctcctctttgcctatctggtcacaactgggggcaacctcagcatcctggcagccgtcttggtggagcccaaactccacgcccccatgtacttcttcctggggaacctgtcagtgctggatgtcggatgtatcactgtcactgttcctgcaatgttgggtcgtctcttgtcccacaagtccacaatttcctatgacgcctgcctctcccagctcttcttcttccaccttctggctgggatggactgcttcctgctgaccgccatggcctatgaccgactcctggccatctgccagcccctcacctacagcacccgcatgagtcagacagtccagaggatgttggtggctgcgtccttggcttgtgccttcaccaacgcactgacccacactgtggccatgtccacgctcaacttctgtggccccaatgaggtcaatcacttctactgtgacctcccacagctcttccagctctcctgctccagcacccaactcaatgagctgctgctctttgctgtgggtttcatcatggcaggcacacctttggttctcatcatcactgcctacagccacgtggcagctgcagttctacgaatccgttcagtggagggccgaaagaaggccttctccacgtgtggctcccacctcaccgtggtttgtcttttctttggaagaggtatcttcaactacatgagactgggttcagaggaggcttcagacaaggataaaggggttggagttttcaacactgttatcaaccctatgctgaaccctcttatctacagcctcagaaaccctgatgttcagggtgctctgtggcaaatatttttggggaggagatcactgacctga

SEQ ID NO: 31250 - DNA, 398 bp, Homo sapiens
ttttttcccagaagcccactgcttgctaattgtccttttttgacttcttctatggcattaatgtaaagaaggaagagtttcttcttcacacatgagcaggacttgattcaacttactgtgctgttccatcaaaaagcagaagggaaaacaaaatagaaatgttccaatcatgaggccaagggtcaggtctactttacagtgggctcatggcttttgtggtgaacgcaatgggactgtgttggtgaggttttgcttgcggggtgtggcgctgcgttaagcctgtcatgcacgtgatctcacacgttcctctcaaaggccatgaggtctttggatcttagcactctaaggaaggagaaaagccacatggtccttacggctgcctttgtgccctaccaggg

SEQ ID NO: 31251 - DNA, 159 bp, Homo sapiens
agttattttataaatttgaccataaatttactctaaattgactaagtaattccactcctacacacacactaaaggaaaaatcttcaatgtgtatgtgcaatcgtgtacaaatcaaaatatgtaaaaaaagttcatacagcaaaaaacttgaaaaataaa

SEQ ID NO: 31252 - DNA, 681 bp, Homo sapiens
cagggaaagaccttagctctaagctcacccaccaaaaaaaccatgagataaaagtgcaacacagcccatttcccagtagtctgccttgccctggcagactgctccggactcttctaggaaattcctctgtctcatttgtcctcatctccttcttgctttgctttgctgtggacctctcctccttctccttgacctctctgcctcagtctttgttaatgttgaatcaggatttgagagctggagcccatctttctgcctccatccaaagaggccttttaactcagcctccccttctggaagaagacttggccttttctctgcctgcatgtccctgtgcagaggaaggctgtctctcaagggtaaccccaatctgcctgtgctgctctttcataccctgtctcagtaactatttggccatgtgctccctgggtacacaagttttcagatctactgatagacctgcaggaactctctcatgttagagcaatactggctcaggcaaaacacctggtgggaagttgtatcttgtatagccactgcatattacatagccaggagtaccccttgaggctaattctaccaaccaagggatttgtgctcttcatctgtgggtacttgtccttgtttaggcctcacctccctgctcctgtgtcttaccaataaacttataaagcccaagtg

SEQ ID NO: 31253 - DNA, 671 bp, Homo sapiens
cctgagatagcgccactgcactccagcctgggtgacagagcaagcttctgtctcaataacaaaaaaacaaaaaacaaaaaccaacaagattctgcagttctaaagtattttagataaatatttcagaaagaatctaacaaaacctaggtttcagttctctccagaaatcacaaagattaaaagtaaaataactgttcttattattaggaacattctaaaactggtaaacctagcagtaaaaataaaataccaaaatgtttcccagtaaagtgtccatttaggacacagtgaaggcaaatttggcttaatctcttactactctaagaaatgtattattttatggccagacactgtggctcacacctgtaatctcagcatctggggaggatgaggtgggaggattgctttagtccaggagttcgagaccagcctgggcaacaaagcaaggccctcatctctcttaaaaaaataaataaataaagtaaaaacaaaacaaaaacaaaaacaaaaaatcaggaatgtattattttaatgtaaaaagtaattcactttttattttcagtcactgaagaggcaaggtgttgaactgaacaatggatacagaagaagtacaagggatcagtaaaaaaataatagtaaagaaagcaaccattcattcattcatttagatt

SEQ ID NO: 31254 - DNA, 615 bp, Homo sapiens
cagctttgttttgtcataaactgtattataatttgaatgaggtcactgtttttcttttggatccctaaaaacctggtttaaatttaatttttggttacatttcaaactcatttaaaaaccattcataggagcacaaataacgtggctatataaagaagtacagaaatgacctgataatcaggctcagtgtacacagctgcgagaagagcaagcggtttcagaagcttagagctgtaatggaagtgaaatcagcatggtcaaatgcagttctcattactttggagccttttaaatatttttgttcaatattttcattaatatgctctagatgctatataaatttgattactatatatttgctttggcttctttttattgctattgggttttgttaaaagttaccatcaagctacaggtatcaacaccttccttagtattccatttcatcacttgcttgcattttttctgacttgtttctgggaaagtcatttcgtcttagcttgcggttatttaattattttgtgtgtgagacttaggaggttggcatagaacttggttggctagctttagttatgtaactaaaccatgcctcattaaggctctgttaaaaaaaaa

SEQ ID NO: 31255 - DNA, 407 bp, Homo sapiens
  misc_feature (370)..(370): n is a, c, g, or t
cctggctctagagcccacactcctgactgctgtactctgctcctctcaataacagctgacagttcatggttacttggcaagggttttcacgtcacaacggatttaattgccacagcattgctaggtggtgggttccctagtttcctgaattttcagaaacgggatgttttgtttgtttgtattttgagacagagtctcgctctgtcacccaggctggagagcagtggtgcgatctcggctcactgcaacctctgcctcccaggagaatcacttgaaccagggaggcagagtttgcagtgaatggagattgcgccgctgcactccagcctgggcgacagagtgagactgcatcacaagaaaaaaaattttncaagggatggttcacgagacacattttggggccgaag

SEQ ID NO: 31256 - DNA, 618 bp, Homo sapiens
ggtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctcaaaaacaaaccggc

SEQ ID NO: 31257 - DNA, 599 bp, Homo sapiens
ttctctgccctccagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggtcagccttggcggcgcgctttctcctcttcctcccacggccccggcttttcactttcacgccattcaagtgtcaaagcagccaccttctctttcccttctctctcctccttttcctgacctttggatctgtaagaaatgaagaaggttgccccttcatactggttgctgatgcttctgacatgaaacagacaggtcagtgttgatgtttttccgcaaaaaaaaaaaa

SEQ ID NO: 31258 - DNA, 440 bp, Homo sapiens
agggtctgcagtggcctggtgtcacctctgcagaagcagctgttctgtggcccaatggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcagaaatgaagaaggttgccccttcatactggttgctgatgcttctgacatgaaacagacaggtcagtgttgatgtttttccgcaaaaaaaaaaaa

SEQ ID NO: 31259 - DNA, 3102 bp, Homo sapiens
ggtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagctggtccgggagttcgtggcccagaacaataccgtgcaaatcaagcatgtgatccagaccctgtcccaggagtttgccctgtctcagcacccccacagccggaaagggggcctcatcggcctggccgcctgctccatcgcactgggcaaggactcagggctctacctgaaggagctgatcgagccagtgctgacctgcttcaatgatgcagacagcaggctgcgctactatgcctgcgaggccctctacaacatcgtcaaggtggcccggggcgctgtgctgccccacttcaacgtgctctttgacgggctgagcaagctggcagccgacccagaccccaatgtgaaaagcggatctgagctcctagaccgccttttaaaggacattgtgactgagagcaacaagtttgacctggtgagcttcatccccttgttgcgagagaggatttactccaacaaccagtatgcccggcagttcatcatctcctggatcctggttctggagtcggtgccagacattaacctgctggattacctgccggagatcctggatggactcttccagatcctgggtgacaatggcaaagagattcgcaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtggaggtccagatggttcctgtgactccagcttcagtagcggcatcagtgtcttcactgcagccagcactgaaagagccccagtgacccttcacctcgacgggatcgtgcaggtcctaaactgccacctcagtgacacggccattgggatgatgaccaggattgcagttctcaagtggctctaccacctctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctcaaaaacaaaccggc

SEQ ID NO: 31260 - DNA, 2951 bp, Homo sapiens
ggtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagactcagggctctacctgaaggagctgatcgagccagtgctgacctgcttcaatgatgcagacagcaggctgcgctactatgcctgcgaggccctctacaacatcgtcaaggtggcccggggcgctgtgctgccccacttcaacgtgctctttgacgggctgagcaagctggcagccgacccagaccccaatgtgaaaagcggatctgagctcctagaccgccttttaaaggacattgtgactgagagcaacaagtttgacctggtgagcttcatccccttgttgcgagagaggatttactccaacaaccagtatgcccggcagttcatcatctcctggatcctggttctggagtcggtgccagacattaacctgctggattacctgccggagatcctggatggactcttccagatcctgggtgacaatggcaaagagattcgcaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtggaggtccagatggttcctgtgactccagcttcagtagcggcatcagtgtcttcactgcagccagcactgaaagagccccagtgacccttcacctcgacgggatcgtgcaggtcctaaactgccacctcagtgacacggccattgggatgatgaccaggattgcagttctcaagtggctctaccacctctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctcaaaaacaaaccggc

SEQ ID NO: 31261 - DNA, 2176 bp, Homo sapiens
gctcggtacccctcgataagggccaaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtggaggtccagatggttcctgtgactccagcttcagtagcggcatcagtgtcttcactgcagccagcactgaaagagccccagtgacccttcacctcgacgggatcgtgcaggtcctaaactgccacctcagtgacacggccattgggatgatgaccaggattgcagttctcaagtggctctaccacctctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctcaaaaacaaaccggc

SEQ ID NO: 31262 - DNA, 1155 bp, Homo sapiens
gcgaattcactagtgattagagactgcgagaaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctcaaaaacaaaccggc

SEQ ID NO: 31263 - DNA, 2334 bp, Homo sapiens
cctctagaatggccccgcccagctgcttttgatctttgttgaactaaagtcagctgagccccgctagggagccaggagcgccaggcccagaaaagcagcagccgcagccgtagacatgtccaagatgttttctggtggtgcatcttcagcagggaggcgggaagggaacaggtgtgggcaggcagagctgagcaggggtgcaggaggccgcctccgggccccagatggcatctcaactgtgggaagagtccccctgccccggtcctgcccagcaggctggtgggccacctgaagcaactgtcaggctctggccgttgactcttcctgctggactgaactcatggccaagaattcgttttgggggagctccattttgtctcccccaaaatggcctcctttatttccaccctcaagctgctgggccccggctggcctcacgttggaggggcagaactgtagccacagtggcacctgccagatacctaagctggggctggataccaggtgaagctcttacacatcgtgtcaaggcatcttggcagccaccccagggccgctccttaggtagccctcgctttgcagatgaggaaacagtcacatgctcaagtcacaccgctaggaagcggtggagttatggttgggtccaggtctgtctagatcctgtgctctgccagtgcctgcaccccccttcccggccccgccgattggcatcttttcataaacttgaagggccccaagactctctgcttagctgagcagcccacagtcttcctgagaccccttcccaggtccaccaggcctcagggcctggaaacagatacttcctagcccacatggatctgctcctccaaaccagtgaggccaaagggagggagcagaacatttcatgagacactgctggagggtgagtaggaacaggacaggagcccaaggggatctcatcgccaggggcaagctaagcactgggcttgacagggacagcaaggctaccgcattgcaccattatagggagcatcatgcacactagctgtgcagtgcacaacctgtgttgctgtacagagcaactggagagggtggcagcaacaggaatgtaggagctgtaggcatgtccagtggtgagaccggcattcctcctcccagggacagtgagtgactgcaggccttggggccccaacactcaaaaacaaatgtcctgccaagtggagggcccggcagaggctcttcagcaattcccattttccccagtcctagccctgcctctcagagaaagggccaagctgccacctcccccttctccccagaccctgttccaggccccagctggcttcctggctggctgctagccctggctttcaccccaaagggagccactcgtaaacaggaaatgcttcccaatgcgatgcctgctctgggcgccatcgccagcccacaggccgagggcaatagccaagcagcagtgttagctgttcccaccaactgcggaagagggggatgctcaggggcttcccagctctggggcccgccatgacggaagagttgccaggcctgagacagacgcccacaggccgagcccaccagcctgtggctctgctctgaccccactgccctccagcagtaacccccctgtgagctgatccctgacactgagcatttctgctccctcttcccagagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctcaaaaacaaaccggc

SEQ ID NO: 31264 - DNA, 1961 bp, Homo sapiens
attaggctagtacgagccctgtgtttatcggcaccgaggagctgctgggccccggctggcctcacgttggaggggcagaactgtagccacagtggcacctgccagatacctaagctggggctggataccaggtgaagctcttacacatcgtgtcaaggcatcttggcagccaccccagggccgctccttaggtagccctcgctttgcagatgaggaaacagtcacatgctcaagtcacaccgctaggaagcggtggagttatggttgggtccaggtctgtctagatcctgtgctctgccagtgcctgcaccccccttcccggccccgccgattggcatcttttcataaacttgaagggccccaagactctctgcttagctgagcagcccacagtcttcctgagaccccttcccaggtccaccaggcctcagggcctggaaacagatacttcctagcccacatggatctgctcctccaaaccagtgaggccaaagggagggagcagaacatttcatgagacactgctggagggtgagtaggaacaggacaggagcccaaggggatctcatcgccaggggcaagctaagcactgggcttgacagggacagcaaggctaccgcattgcaccattatagggagcatcatgcacactagctgtgcagtgcacaacctgtgttgctgtacagagcaactggagagggtggcagcaacaggaatgtaggagctgtaggcatgtccagtggtgagaccggcattcctcctcccagggacagtgagtgactgcaggccttggggccccaacactcaaaaacaaatgtcctgccaagtggagggcccggcagaggctcttcagcaattcccattttccccagtcctagccctgcctctcagagaaagggccaagctgccacctcccccttctccccagaccctgttccaggccccagctggcttcctggctggctgctagccctggctttcaccccaaagggagccactcgtaaacaggaaatgcttcccaatgcgatgcctgctctgggcgccatcgccagcccacaggccgagggcaatagccaagcagcagtgttagctgttcccaccaactgcggaagagggggatgctcaggggcttcccagctctggggcccgccatgacggaagagttgccaggcctgagacagacgcccacaggccgagcccaccagcctgtggctctgctctgaccccactgccctccagcagtaacccccctgtgagctgatccctgacactgagcatttctgctccctcttcccagagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctcaaaaacaaaccggc

SEQ ID NO: 31265 - DNA, 2957 bp, Homo sapiens
ggtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagctggtccgggagttcgtggcccagaacaataccgtgcaaatcaagcatgtgatccagaccctgtcccaggagtttgccctgtctcagcacccccacagccggaaagggggcctcatcggcctggccgcctgctccatcgcactgggcaaggactcagggctctacctgaaggagctgatcgagccagtgctgacctgcttcaatgatgcagacagcaggctgcgctactatgcctgcgaggccctctacaacatcgtcaaggtggcccggggcgctgtgctgccccacttcaacgtgctctttgacgggctgagcaagctggcagccgacccagaccccaatgtgaaaagcggatctgagctcctagaccgccttttaaaggacattgtgactgagagcaacaagtttgacctggtgagcttcatccccttgttgcgagagaggatttactccaacaaccagtatgcccggcagttcatcatctcctggatcctggttctggagtcggtgccagacattaacctgctggattacctgccggagatcctggatggactcttccagatcctgggtgacaatggcaaagagattcgcaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtggaggtccagatggttcctgtgactccagcttcagtagcggcatcagtgtcttcactgcagccagcactgaaagagccccagtgacccttcacctcgacgggatcgtgcaggtcctaaactgccacctcagtgacacggccattgggatgatgaccaggattgcagttctcaagtggctctaccacctctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgccccgtgtcccacctctcgggatcctctagaacaccacacc

SEQ ID NO: 31266 - DNA, 2968 bp, Homo sapiens
ggtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagctggtccgggagttcgtggcccagaacaataccgtgcaaatcaagcatgtgatccagaccctgtcccaggagtttgccctgtctcagcacccccacagccggaaagggggcctcatcggcctggccgcctgctccatcgcactgggcaaggactcagggctctacctgaaggagctgatcgagccagtgctgacctgcttcaatgatgcagacagcaggctgcgctactatgcctgcgaggccctctacaacatcgtcaaggtggcccggggcgctgtgctgccccacttcaacgtgctctttgacgggctgagcaagctggcagccgacccagaccccaatgtgaaaagcggatctgagctcctagaccgccttttaaaggacattgtgactgagagcaacaagtttgacctggtgagcttcatccccttgttgcgagagaggatttactccaacaaccagtatgcccggcagttcatcatctcctggatcctggttctggagtcggtgccagacattaacctgctggattacctgccggagatcctggatggactcttccagatcctgggtgacaatggcaaagagattcgcaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtggaggtccagatggttcctgtgactccagcttcagtagcggcatcagtgtcttcactgcagccagcactgaaagagccccagtgacccttcacctcgacgggatcgtgcaggtcctaaactgccacctcagtgacacggccattgggatgatgaccaggattgcagttctcaagtggctctaccacctctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccccccggaccattcagcgcctccgggccattcaactaaccggggccgaga

SEQ ID NO: 31267 - DNA, 2779 bp, Homo sapiens
ggtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagctggtccgggagttcgtggcccagaacaataccgtgcaaatcaagcatgtgatccagaccctgtcccaggagtttgccctgtctcagcacccccacagccggaaagggggcctcatcggcctggccgcctgctccatcgcactgggcaaggactcagggctctacctgaaggagctgatcgagccagtgctgacctgcttcaatgatgcagacagcaggctgcgctactatgcctgcgaggccctctacaacatcgtcaaggtggcccggggcgctgtgctgccccacttcaacgtgctctttgacgggctgagcaagctggcagccgacccagaccccaatgtgaaaagcggatctgagctcctagaccgccttttaaaggacattgtgactgagagcaacaagtttgacctggtgagcttcatccccttgttgcgagagaggatttactccaacaaccagtatgcccggcagttcatcatctcctggatcctggttctggagtcggtgccagacattaacctgctggattacctgccggagatcctggatggactcttccagatcctgggtgacaatggcaaagagattcgcaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtggaggtccagatggttcctgtgactccagcttcagtagcggcatcagtgtcttcactgcagccagcactgaaagagccccagtgacccttcacctcgacgggatcgtgcaggtcctaaactgccacctcagtgacacggccattgggatgatgaccaggattgcagttctcaagtggctctaccacctctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactccccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctcaaaaacaaaccggc

SEQ ID NO: 31268 - DNA, 2141 bp, Homo sapiens
ggtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagctggtccgggagttcgtggcccagaacaataccgtgcaaatcaagcatgtgatccagaccctgtcccaggagtttgccctgtctcagcacccccacagccggaaagggggcctcatcggcctggccgcctgctccatcgcactgggcaaggactcagggctctacctgaaggagctgatcgagccagtgctgacctgcttcaatgatgcagacagcaggctgcgctactatgcctgcgaggccctctacaacatcgtcaaggtggcccggggcgctgtgctgccccacttcaacgtgctctttgacgggctgagcaagctggcagccgacccagaccccaatgtgaaaagcggatctgagctcctagaccgccttttaaaggacattgtgactgagagcaacaagtttgacctggtgagcttcatccccttgttgcgagagaggatttactccaacaaccagtatgcccggcagttcatcatctcctggatcctggttctggagtcggtgccagacattaacctgctggattacctgccggagatcctggatggactcttccagatcctgggtgacaatggcaaagagattcgcaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtggaggtccagatggttcctgtgactccagcttcagtagcggcatcagtgtcttcactgcagccagcactgaaagagccccagtgacccttcacctcgacgggatcgtgcaggtcctaaactgccacctcagtgacacggccattgggatgatgaccaggattgcagttctcaagtggctctaccacctctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggtcagccttggcggcgcgctttctcctcttcctcccacggccccggcttttcactttcacgccattcaagtgtcaaagcagccaccttctctttcccttctctctcctccttttcctgacctttggatctgtaagaaatgaagaaggttgccccttcatactggttgctgatgcttctgacatgaaacagacaggtcagtgttgatgtttttccgcaaaaaaaaaaaa

SEQ ID NO: 31269 - DNA, 1890 bp, Homo sapiens
  misc_feature (1796)..(1796): n is a, c, g, or t
ggtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagctggtccgggagttcgtggcccagaacaataccgtgcaaatcaagcatgtgatccagaccctgtcccaggagtttgccctgtctcagcacccccacagccggaaagggggcctcatcggcctggccgcctgctccatcgcactgggcaaggactcagggctctacctgaaggagctgatcgagccagtgctgacctgcttcaatgatgcagacagcaggctgcgctactatgcctgcgaggccctctacaacatcgtcaaggtggcccggggcgctgtgctgccccacttcaacgtgctctttgacgggctgagcaagctggcagccgacccagaccccaatgtgaaaagcggatctgagctcctagaccgccttttaaaggacattgtgactgagagcaacaagtttgacctggtgagcttcatccccttgttgcgagagaggatttactccaacaaccagtatgcccggcagttcatcatctcctggatcctggttctggagtcggtgccagacattaacctgctggattacctgccggagatcctggatggactcttccagatcctgggtgacaatggcaaagagattcgcaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtggaggtccagatggttcctgtgactccagcttcagtagcggcatcagtgtcttcactgcagccagcactgaaagagccccagtgacccttcacctcgacgggatcgtgcaggtcctaaactgccacctcagtgacacggccattgggatgatgaccaggattgcagttctcaagtggctctaccacctctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctgaattttaatatgtctnttagtagtatgggatatatttctgagggagagatttacggtataactcatggacgatctatttgcttttcatagagcagtaagtttggacccat

SEQ ID NO: 31270 - DNA, 1788 bp, Homo sapiens
  misc_feature (1365)..(1366): n is a, c, g, or t
  misc_feature (1444)..(1444): n is a, c, g, or t
  misc_feature (1605)..(1605): n is a, c, g, or t
  misc_feature (1644)..(1645): n is a, c, g, or t
  misc_feature (1649)..(1650): n is a, c, g, or t
  misc_feature (1655)..(1655): n is a, c, g, or t
  misc_feature (1657)..(1659): n is a, c, g, or t
  misc_feature (1662)..(1662): n is a, c, g, or t
  misc_feature (1676)..(1676): n is a, c, g, or t
  misc_feature (1682)..(1682): n is a, c, g, or t
  misc_feature (1695)..(1695): n is a, c, g, or t
  misc_feature (1697)..(1697): n is a, c, g, or t
  misc_feature (1709)..(1709): n is a, c, g, or t
  misc_feature (1720)..(1721): n is a, c, g, or t
  misc_feature (1725)..(1726): n is a, c, g, or t
  misc_feature (1737)..(1737): n is a, c, g, or t
  misc_feature (1742)..(1743): n is a, c, g, or t
  misc_feature (1750)..(1750): n is a, c, g, or t
  misc_feature (1752)..(1752): n is a, c, g, or t
  misc_feature (1754)..(1755): n is a, c, g, or t
  misc_feature (1757)..(1757): n is a, c, g, or t
  misc_feature (1766)..(1767): n is a, c, g, or t
  misc_feature (1772)..(1772): n is a, c, g, or t
  misc_feature (1774)..(1776): n is a, c, g, or t
  misc_feature (1788)..(1788): n is a, c, g, or t
ggtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagctggtccgggagttcgtggcccagaacaataccgtgcaaatcaagcatgtgatccagaccctgtcccaggagtttgccctgtctcagcacccccacagccggaaagggggcctcatcggcctggccgcctgctccatcgcactgggcaaggactcagggctctacctgaaggagctgatcgagccagtgctgacctgcttcaatgatgcagacagcaggctgcgctactatgcctgcgaggccctctacaacatcgtcaaggtggcccggggcgctgtgctgccccacttcaacgtgctctttgacgggctgagcaagctggcagccgacccagaccccaatgtgaaaagcggatctgagctcctagaccgccttttaaaggacattgtgactgagagcaacaagtttgacctggtgagcttcatccccttgttgcgagagaggatttactccaacaaccagtatgcccggcagttcatcatctcctggatcctggttctggagtcggtgccagacattaacctgctggattacctgccggagatcctggatggactcttccagatcctgggtgacaatggcaaagagattcgcaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtgggtgcactgaggcgcannacttccgtgacatccctccaatgatgcgcaactccctactcgtgagaaaacgtgagaccaacccaaacggggagacantctgcagagtgaccagcgcttcaaaagtgtcaagtttatgaaagacacacagattgaggggctgcaacagattggaggagacaaagaagacagtttagctaaatgcagtgtgagatcctggaacaaaaggccaggaatggaaaaactcgtgatgttcaaantagggtaatcatttagttaatggtagtgtatcgaagttnncctnntgggntnnntcntgaactatggagcngggcanggtggctcacgcntntaatcccagcantttgggaggcnnaggnnggtggatcacntgagnncaggagntngnnancagcctggnnaacangnnnaaaccccatctn

SEQ ID NO: 31271 - DNA, 2011 bp, Homo sapiens
cctctagaatggccccgcccagctgcttttgatctttgttgaactaaagtcagctgagccccgctagggagccaggagcgccaggcccagaaaagcagcagccgcagccgtagacatgtccaagatgttttctggtggtgcatcttcagcagggaggcgggaagggaacaggtgtgggcaggcagagctgagcaggggtgcaggaggccgcctccgggccccagatggcatctcaactgtgggaagagtccccctgccccggtcctgcccagcaggctggtgggccacctgaagcaactgtcaggctctggccgttgactcttcctgctggactgaactcatggccaagaattcgttttgggggagctccattttgtctcccccaaaatggcctcctttatttccaccctcaagctgctgggccccggctggcctcacgttggaggggcagaactgtagccacagtggcacctgccagatacctaagctggggctggataccaggtgaagctcttacacatcgtgtcaaggcatcttggcagccaccccagggccgctccttaggtagccctcgctttgcagatgaggaaacagtcacatgctcaagtcacaccgctaggaagcggtggagttatggttgggtccaggtctgtctagatcctgtgctctgccagtgcctgcaccccccttcccggccccgccgattggcatcttttcataaacttgaagggccccaagactctctgcttagctgagcagcccacagtcttcctgagaccccttcccaggtccaccaggcctcagggcctggaaacagatacttcctagcccacatggatctgctcctccaaaccagtgaggccaaagggagggagcagaacatttcatgagacactgctggagggtgagtaggaacaggacaggagcccaaggggatctcatcgccaggggcaagctaagcactgggcttgacagggacagcaaggctaccgcattgcaccattatagggagcatcatgcacactagctgtgcagtgcacaacctgtgttgctgtacagagcaactggagagggtggcagcaacaggaatgtaggagctgtaggcatgtccagtggtgagaccggcattcctcctcccagggacagtgagtgactgcaggccttggggccccaacactcaaaaacaaatgtcctgccaagtggagggcccggcagaggctcttcagcaattcccattttccccagtcctagccctgcctctcagagaaagggccaagctgccacctcccccttctccccagaccctgttccaggccccagctggcttcctggctggctgctagccctggctttcaccccaaagggagccactcgtaaacaggaaatgcttcccaatgcgatgcctgctctgggcgccatcgccagcccacaggccgagggcaatagccaagcagcagtgttagctgttcccaccaactgcggaagagggggatgctcaggggcttcccagctctggggcccgccatgacggaagagttgccaggcctgagacagacgcccacaggccgagcccaccagcctgtggctctgctctgaccccactgccctccagcagtaacccccctgtgagctgatccctgacactgagcatttctgctccctcttcccagagacagtctaaaggcagcccccaagtcccagaaagctgactccccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctcaaaaacaaaccggc

SEQ ID NO: 31272 - DNA, 484 bp, Homo sapiens
cggaggcgttgaatagccaaacaaggacgatagccagagggcgttcccatggagccaggtctgttggcagatcggcccatattcaggccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggtcagccttggcggcgcgctttctcctcttcctcccacggccccggcttttcactttcacgccattcaagtgtcaaagcagccaccttctctttcccttctctctcctccttttcctgacctttggatctgtaagaaatgaagaaggttgccccttcatactggttgctgatgcttctgacatgaaacagacaggtcagtgttgatgtttttccgcaaaaaaaaaaaa

SEQ ID NO: 31273 - DNA, 388 bp, Homo sapiens
ctgagacctgggcagaggcaggcagagcccacccctgacgatgccctgccaaagcaggagggcacagccagtggtgagtggactccgtccctacacctcacctcctgtcgggggcccagggagccagatgtcataggagttgccttggggcctcacttaagcaaccaggactactttatgtatgtcactcacacaattgtagcagcaacccagcgcagtggcagcagtggttctcccccattctgcagacaggacacagggaagctgagtaccatggccacacactcgcagctagtgaagactggaaccggattggaacccaggcaggctgtctccagcagccatgatcttaacccttcctgcctcaaagaccatgaagcctttcctt

SEQ ID NO: 31274 - DNA, 608 bp, Homo sapiens
gtcattttggaagaaatagagcagtcgctatagacttatgtgggttgctgtcgacatcttgttgttttaggggatgtttccattcaggacacaggcatgttgtgtgccaatgtctcaaggcacaaatggcaattgcacctcttaagggatgcccggtgggtgagcctaaagaacgaaggctggggcacccttgtgctggttgcaaggtcaggctggaagcctaacgctagtcattgcctgtagtgcaggcttctacctgaggatgacactgccttctacttgaaaaaatccccattttagtttcattgttgagaagaagtcagggctgagtgtggtggcccacacctataatcccagcactttgagaggctgaggaggttggatcagttgagtccaggagtttaagaccatcctcggcaatatggcaaaaccctgtctctacaaaaaatataaaaattaaccaggtgtggtggtgcattcctgtggtcccccctactcaagaggatgagaagtgggaggattgcttgagcctgggaggttgaagttgcccaggtggtcgaggctgcatcaagccgtgatctgggcgacagagtgagattccttctcac

SEQ ID NO: 31275 - DNA, 497 bp, Homo sapiens
atcccagtttgggcagaagtctgaaaactgtggatgatatgtacctagcacttggtgttatatttgggaggcagtattgtagagggttagagtttagctcaggagtcagataccctggttcctagcttggcttcttggccagtggctacctgactggaacatgagacaggtgtggggagagctgagtcagcctccatcgcgcccccagggccaggctacctcagaccatagccagaccagagtgagtccagtcagtatcagcagaactcactatccagtcttgtgagcaataaatgcttctcattagatgccactgaggtttttgaatttttttttttatactttaagttttagggtacatgtacacaacgtgcaggtttgttacatatgtatacctatgccatgttggtgtgctgcacccattaactcgtcatttaacattcggtatatctcctaatgctatccctccccactcctcccaccccaaaacaggcccc

SEQ ID NO: 31276 - DNA, 365 bp, Homo sapiens
tattttggacaattggtatatcctatagatctttttcccgtgatttaatgaaatgtaacatttataataattttctttttattgaacatttttgctttgtatattatatgttaccttatttgttaataaaaacacataaataaacttggttaggtattatttatgtggtaactgattttcaacaaaggtgccaaggtatttcaatgggaaaagaatagtcttttcaaaaaaaagaaaggccgggcgcggtagctcacgcctgtaatcccagcactttgggaggctgaggcgggttgatcacgaggtcaggagatcgagaccatcctggctaacacacagtgaaaccccgtctctgctaaaaatac

SEQ ID NO: 31277 - DNA, 1404 bp, Homo sapiens
aggagccttaggaggtacggggagctcgcaaatactccttttggtttattcttaccaccttgcttctgtgttccttgggaatgctgctgtgcttatgcatctggtctctttttggagctacagtggacaggcatttgtgacagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtattatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaat

SEQ ID NO: 31278 - DNA, 2749 bp, Homo sapiens
gcaggctgtacgcccccgtaggtatgggatggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtattatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgtttttttttaaatagacctctcaatttctggaaaactgccttttatctgcccagaattctaagctggtgccccactgaatcttgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattcatttaaaagtctaca

SEQ ID NO: 31279 - DNA, 713 bp, Homo sapiens
gcaggctgtacgcccccgtaggtatgggatggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctggtaagaacctttcagctttgttaagtcctggaatcctactgtctcctgatgagtctgaccacagcaagcccaggcctgagacttggtgggttttactcactttctactgagcattgtacaagaccacatgcaaaaaagactttcctggagaagaaggaagtgttatgattgagagcagctgatggcaggcagctgggatggagctctcccccccgtgtgcttcttcctcctctgcagtctcacatcagtgagcctagatgctcagagtagggtagcctggcccatcccatggggatgggggaaggctgctgcactgaggcccctgagacttgactcttttgttccacacatattctcttctggtcttctctgaccctgtttctgtctttctcaggctcctaggaaacaactgacagaattccaaaagtctcccttcattcggagcactggctttcacgtccctgacttccctaccctctctcactcccttccctacagcccat

SEQ ID NO: 31280 - DNA, 267 bp, Homo sapiens
ggggtcaagggacccccagaatagggtttcttgcccaggcttgggacaatgacactaagtctcccagaatatgggaccttgcccaggcttggaacaatgacacctcccagaatatgggactttgtccaggcttgaggacaatgacagtaagtcatcattcaccccaagccatcaggccttggagctctccttctcaccctgggagaattccaggagattcctggcaaaggtggcaagcctatctcctcctcccatcagggcagccag

SEQ ID NO: 31281 - DNA, 356 bp, Homo sapiens
gctgcttccctgattgtcccagtttccctaattgtgacccaatgtagcaaacccatttcctacaattagctaaatcagtaagattgactttttttcccagaacttacactggaacatagagatcagctaattgatagtgatagcagaaaagaagttatgcagagatatatggtgctattagtgttattaataatacagataacactgtttgcctccaaaacgttttatttaatttctcttcttaatatcaagccaaccaaatataatagtactttctcttttttattttcctttggctcttacattttgacttgcttatgtattttaataaatacaactggaaccaaaaaaaatta

SEQ ID NO: 31282 - DNA, 411 bp, Homo sapiens
ccctgtctccgacgcccagaggaatccttgttggaactgacaatttgaggctagatcagtctggaagaaggagctgaaataagcagtatagcatcgtacaaggagcaccagcttttgagccagatagtactggcaccaaacccaggctatgacacttcccagttgcataattttggccaagtcacttaattcctttgagtctcagtttcttcatttgtaacacgtgcataataatggtacctactttctaagtgtgctgtgaagtatgaataacagctaatgtttaataaatgcttactacatgccatgcactgttctagcagccagggatagctaatgtcataatagacaagttacctgctctcatggagctcatttctattaatagaaggggcagatatgacacaagta

SEQ ID NO: 31283 - DNA, 306 bp, Homo sapiens
atcatttttactttttttgcaggtggcatgatgtcattttgtcattaggcaccaccgtggggactgcatgttgtcaatggacccactatgctcatgatgctccttatcgagttctaccctgtgcagctcccaggccctgctgctggggcagtcgcctggggcccctcaccatctgacggctgtcaccgcaggccaggatgtgcactctcaacagcccaggctttgagggctgctctggagtatgatggatactgtagctgttcgcttttgaaaaagaaagacctgtggcgagagcatttccttctc

SEQ ID NO: 31284 - DNA, 358 bp, Homo sapiens
tttcatgttatatgtgtattctatatattgtgtatatggatactctaaatatatagagtatgtatgtatggagagaatttgtttatgtgtgtgtgtatatatatacatataaacatattcatataaatatatgcctgtatacatatatacactctaaaccccagtttggaagcccttgtttctacattttaatatagaaaaacatttaatttgcttctatatttttaagtgagtctgtccacagattgcttaggcttcctcatcgcctgcttgtgagagttcaagattaaacattctaagggtccaggcgtttttgtgacctagcctcagaagttgcatattgtcagttctcaaatcc

SEQ ID NO: 31285 - DNA, 544 bp, Homo sapiens
ggtggttttccttcccagtctccttaccctcttcccattcccctcctttcctcccttctgttaccacttcccagcagaatattaacatgaaggagaaaatggaatgcattattcctctcctaattaagaaaccccaacagatgtgtttctctgcttgtgtgtctgtatctgaatactcacgatttttaaagtagaacatacttttaaaggaaataatattttcttgttttgtaagtctttagtcatttttggggaatatcacccactccccagttatggaacccatcaggaagaaccattatgctgtctacctaagtcgcagttcacttaccctttgtccctaaccctgtccagctgcgactgttgtggctcacagagtaggtgaaagaagtgcatcagtgcccatcttcccaaacccctccaggcttgcttggcagttagtaaaatgctctatgctgtgggcctctaaaatcacctcttattgatccctgcaattcttgtgtggtaagattagttgtaagcattttgttttcagaatgatatg

SEQ ID NO: 31286 - DNA, 496 bp, Homo sapiens
ggtatgtgacatcgttactcatcatgggtggtgttaactttgatcatttggctaagttggtgtctgccacatttctctgttgtaaagttactattttttccctttccataacctagtctttggatgtgagtcactaagtgccccccattctcaagcggagaggaattaagctccatgcccttgagagggaaatggcttcatatattttttgaaactctgggctgggctgacgcctgtaatcccagcactttgggaggcagatgtaggtggatcgcctgaggtcaggagttcgagatcagcctggctaacatgtcgaaacccctctttactaaaaatacaaaaattagccgggcatggtggcaggcgcctgtaatcccagctactcaggaggccgaggcagaagaatcccttgaacccgggaggcggtggttgcagtgagctgagattgcaccattgcactccagcctgggcaacaagagtgaaactctgtctcaaa

SEQ ID NO: 31287 - DNA, 395 bp, Homo sapiens
gcttaagagtggggaaaaaggtattgatatacgtctttgaaacatttacaaacacatattctacttaaacagtcaaggaaactcaaactaagaaatttaaataaaaacagtttcatatcaactagcccctttacttgtcttaggatctttttcagcaagtgcaacatttctataaaactatccctctattccaactagcggctaccaaatctgaaatcttgaatccacaattttattctattcttggcaaataacaaaatgttcttattgtttgcccccttcatcttcatgtccacactagataatggtattcgtatgcataactctctctttttatagtttaaactatatggtttaagggaaaaaaacttggttaaaacttttaaagtaaccta

SEQ ID NO: 31288 - DNA, 456 bp, Homo sapiens
agtgggaaaagctgcttgagtgaaaaaccaccgacctgcagtttgagcagaagtgaaatggtgggaattaactgtctgcaactcacttttaatcagttaggagtagtttgcacagagtagtttgcagtcattttgaagaacagtgagaggtttgtgttttcactcctggaacaggcggtctccactgggtcatcacatccccagtttattattcacctgtgcagatctgtatacatttgatcttgatagacacctgagctgatgcattgaattctcaagtgagacgatatatctccttttatagctggtcatttggtcacacaggatgttaaagaagaagagtgaggaatttatctaaggacttcttcccattttctgtcccgtaatggtcaaagtttgtcctttggagcctttattcttctacacattcattttattttgctatgaactacatgt

SEQ ID NO: 31289 - DNA, 216 bp, Homo sapiens
taactggagtgaggcaggattgcttgaaagcttactcaaagattcttaaggagcgaggtgcagtggctcacgcctgtaatcccagcactttgataggctgaggagggtggaacatctgaggtcaggagtttgagatcatcttggccagcatggtgaaacccgtctctactaaaaatacaaaaattagctggatagtggcggctgcctgtagcccca

SEQ ID NO: 31290 - DNA, 319 bp, Homo sapiens
attaacattttgttaaaattgaataatgtcagaaagtttgtttgctttgcctgattggtttggcaatgaagatttgctttgttcattacattatgtggcagaccatttgcacaagtagcctctactaagtctgcagtttcaagatttggaagaaaatatacttgaatgtaagatttagttaaatatttctatatgatgaaatgtttatatttttaaatataagaactcaaggccaggcatggcggcttacacctgtaatcccaacactttgggaggccaggagaatcacttgggcccaggagtttgagtccagcctgag

SEQ ID NO: 31291 - DNA, 5411 bp, Homo sapiens
agggcgcctttggcttcagcgcttcgcccccgcgctgtgccctctgtcggcggcgtggggcagctgtagcagcgttggcggcaggaggcggcggccgcgtcgacgtcgacccagactggagcgacgtttaaagaaggggcagaatcgctggggagtgcggcttcttcttgttgggggactcccagccttccgcgcgtccggaggaggagaagcggcggcgccgggaagcaggcatggagagtagaaaactgatttctgctacagacattcagtactctggcagtctgctgaactccttgaatgagcaacgtggccatggactcttctgtgatgttaccgttattgtggaagaccgaaaattccgggctcacaagaatattctttcagcttctagtacctacttccatcagctcttctctgttgctgggcaagttgttgaactgagctttataagagcagagatctttgcagaaattctcaattatatctatagttctaaaattgttcgtgttagatcagatttgcttgatgagttaattaaatcagggcagttattaggagtgaaatttatagcagagcttggtgtcccattgtcacaggttaaaagcatctcaggtacagcgcaggatggtaatactgagcctttacctcctgattctggtgacaagaaccttgtaatacagaaatcaaaagatgaagcccaagataatggggctactataatgcctattataacagagtctttttcattatctgccgaagattatgaaatgaaaaagatcattgttaccgattctgatgatgatgatgatgatgtcattttttgctccgagattctgcccacaaaggagactttgccgagtaataacacagtggcacaggtccaatctaacccaggccctgttgctatttcagatgttgcacctagtgctagcaataactcgccccctttaacaaatatcacacctactcagaaacttcctactcctgtgaatcaggcaactttgagccaaacacaaggaagtgaaaaattgttggtatcttcagctccaacacatctgactcccaatattattttgttaaatcagacaccactttctacaccaccaaatgtcagttcttcacttccaaatcatatgccctcttcaatcaatttacttgtgcagaatcagcagacaccaaacagtgctattttaacaggaaacaaggccaatgaagaggaggaggaggaaataatagatgatgatgatgacactattagctccagtcctgactcggccgtcagtaatacatctttggtcccacaggctgatacctcccaaaataccagttttgatggatcattaatacagaagatgcagattcctacacttcttcaagaaccactttccaattccttaaaaatttcagatataattactagaaatactaatgatccaggcgtaggatcaaaacatctaatggagggtcagaagatcattactttagatacagctactgaaattgaaggcttatcgactggttgcaaggtttatgcaaatatcggtgaagatacttatgatatagtgatccctgtcaaagatgaccctgatgaaggggaggccagacttgagaatgaaataccaaaaacgtctggcagcgagatggcaaacaaacgtatgaaagtaaaacatgatgatcactatgagttaatagtagatggaagggtctattatatctgtattgtatgcaaaaggtcatatgtctgtctgacaagcttgcggagacattttaacattcattcttgggagaagaagtatccgtgccgttactgtgagaaggtatttcctcttgcagaatatcgcacaaagcatgaaattcatcacacaggggagcgaaggtatcagtgtttggcctgtggcaaatctttcatcaactatcagtttatgtcttcacatataaagtcagttcatagtcaagatccttctggggactcaaagctttatcgtttacatccatgcaggtctttacaaatcagacaatatgcatatctttccgatagatcaagcactattcctgcaatgaaggatgatggtattgggtataaggttgacactggaaaagaacctccagtagggaccactacatctactcagaacaagccaatgacctgggaagatatttttattcagcaggaaaatgattcaatttttaaacaaaatgtaacagatggcagtactgagtttgaatttataataccagagtcttactaaactcctttgaaatactagaaagttttgttttggatgatggggcaggggtttcagaagatctgtaaaacaaattaaggtgcgaacaagttaatttgatctgccacattatctgaaggaagtgtagtgggatttttgttgataatttttagaagcaaattttcctgaaagttttgagtagaggtgagaccccctccccaagtatctgtttatatagttagttttcagctcatttaaaagaggcaaaaattaaaagcttggagagatagtttcctgaatagaatttgaagcagtctgaatgttctttgaaaataactggagttattagcataccctagtacatcttacagctttccccttccatgttagcactttactgctgaattctcaattttcttaacattgagacaataaatgtgtgttttgtcttgtatatggcataaagagtaaataagttttagagttgttctggaaaatgtcagaataagtcagtacttgggttgtgtaatctgctagtccaagcgaacagcaacctcctgctaccctccctctatgaaaatagccatgcagacaagtctctcatctgaagaacaaattagatttagctaattagaattaatcctggctttcattgccatagtctgtaaaagactttggtggctagaccactttatacctttgcagtgtggtctctgggggcaaaaaactaatgaaaacaatctctgtaatggcagataggaggagatgaaaagttctgttgcatggatttttaattctctggctaccacatagtagagaatggaatgaagatttccttttggcttcttaaggttaaaaatattcccatgaacatgaaaattttcaaattttgaatctgaaagccaccaaatgtatctttatgtataaatccttgtaaatgatagattccatgggtgagactttacatattttgggtgggaggctactggcatatatttttaaatgttcatattgcgtagaatctccactaggaagtctttatttgaaatagttgaatcagtgatctagtattttcctttcggcaagatttgttaggtttttaccccttctaaaataagttttattccatctgcaaattgctgcaatattatagtaatcagaaactacataaggaatgttatataggcttgtcagttcccatttttcttgacaacaataaataccacttttaaaaatgacacatatttaaacacttagaaaataaagttaacacttactgaagtgctagtactaaactgtgctagtactaaaagaaaacaggttggaacatacatatagcctagcatttataacagaattgttgaacgtctgtaaatgatttttttttttttggcaaaggaaaaaattgatactggaaaagattgttgtgcatagttattagtcatttgtaaccttgcttaagtatttcttagtccaacatagatattttctttctcctgaccatgtattttaaaatatagtctatttcttgactttgaacttaaagctttaatcataatttctcatgtatacatcgttcttctgatggtaagctggatttgaaggtagtggtttcagtgtttcttaagttggtagctgagggtatcaggcatcagttcatgcaataatacaagaaaaaaaatcctttgcttgccaagaggtagagtgatgtgcatttatctgttttctgttctgtaagtctagaccttcaaaccatttgtaaactaacccctgggaaatttgaaattacctgataacttaagactctgtgatctctggaatcaccatatgtttcttttttgtgtagatattaataacattactctttgactatagtgtgcactctgaaatgtactcagtgaaaatttgttttgagtttcattaatgctatttcaccagttagacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaattctgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaagttcagaattcatgtgaaatacttctttggggcaaaagtccttcattcctggtatttattggattggaaatctgtagcaagatgctgtttaaaattaccatattgtttttttatcttatacttagctctctggctattgaacttccttttcttgtttgaagttagcttcaaatttgctcctatgctaaattacctgtaaatattctggataggaactacttgaaatagtaatttgttaaaagatatgacaaaatgaaaatgcttaaactacagaaatttaaaaatgccataacaatcttgcgagactaactttaaaatatactttaaatgattattatgattttggtggtaacgatcccccacacacaaccactatgaagaaataatgccgcatttttcccccattgtaccaaaaagataaaaaaatggtaaacactgatcaaggtattttgtattgtcaaggcatgcatattctaaagaattaaatgctaacttaacagcactggctttctggctggtcaactatatgaaaccttgttcattcctccgagtactgtaatgttcacacttgtacaatcttccctgtcatgactttaagttctacttttcattaaccatggcctgatattagttcttagagcttcttgtggcaaaaataaaatgatttaattctgaaaagacaacacaagaaacaaatttgtcgggccgcgccagaaagatttaacactcggggggggccagtacagcaggctacgttccagaccggagaaggggggttcacaaaaaccgggacggtgaaccaagtggtggtaaagccgcacagcccccgggagggagaaaacgacggagaccaagacaatcgaccagagc

SEQ ID NO: 31292 - DNA, 5216 bp, Homo sapiens
agggcgcctttggcttcagcgcttcgcccccgcgctgtgccctctgtcggcggcgtggggcagctgtagcagcgttggcggcaggaggcggcggccgcgtcgacgtcgacccagactggagcgacgtttaaagaaggggcagaatcgctggggagtgcggcttcttcttgttgggggactcccagccttccgcgcgtccggaggaggagaagcggcggcgccgggaagcaggcatggagagtagaaaactgatttctgctacagacattcagtactctggcagtctgctgaactccttgaatgagcaacgtggccatggactcttctgtgatgttaccgttattgtggaagaccgaaaattccgggctcacaagaatattctttcagcttctagtacctacttccatcagctcttctctgttgctgggcaagttgttgaactgagctttataagagcagagatctttgcagaaattctcaattatatctatagttctaaaattgttcgtgttagatcagatttgcttgatgagttaattaaatcagggcagttattaggagtgaaatttatagcagagcttggtgtcccattgtcacaggttaaaagcatctcaggtacagcgcaggatggtaatactgagcctttacctcctgattctggtgacaagaaccttgtaatacagaaatcaaaagatgaagcccaagataatggggctactataatgcctattataacagagtctttttcattatctgccgaagattatgaaatgaaaaagatcattgttaccgattctgatgatgatgatgatgatgtcattttttgctccgagattctgcccacaaaggagactttgccgagtaataacacagtggcacaggtccaatctaacccaggccctgttgctatttcagatgttgcacctagtgctagcaataactcgccccctttaacaaatatcacacctactcagaaacttcctactcctgtgaatcaggcaactttgagccaaacacaaggaagtgaaaaattgttggtatcttcagctccaacacatctgactcccaatattattttgttaaatcagacaccactttctacaccaccaaatgtcagttcttcacttccaaatcatatgccctcttcaatcaatttacttgtgcagaatcagcagacaccaaacagtgctattttaacaggaaacaaggccaatgaagaggaggaggaggaaataatagatgatgatgatgacactattagctccagtcctgactcggccgtcagtaatacatctttggtcccacaggctgatacctcccaaaataccagttttgatggatcattaatacagaagatgcagattcctacacttcttcaagaaccactttccaattccttaaaaatttcagatataattactagaaatactaatgatccaggcgtaggatcaaaacatctaatggagggtcagaagatcattactttagatacagctactgaaattgaaggcttatcgactggttgcaaggtttatgcaaatatcggtgaagatacttatgatatagtgatccctgtcaaagatgaccctgatgaaggggaggccagacttgagaatgaaataccaaaaacgtctggcagcgagatggcaaacaaacgtatgaaagtaaaacatgatgatcactatgagttaatagtagatggaagggtctattatatctgtattgtatgcaaaaggtcatatgtctgtctgacaagcttgcggagacattttaacattcattcttgggagaagaagtatccgtgccgttactgtgagaaggtatttcctcttgcagaatatcgcacaaagcatgaaattcatcacacaggggagcgaaggtatcagtgtttggcctgtggcaaatctttcatcaactatcagtttatgtcttcacatataaagtcagttcatagtcaagatccttctggggactcaaagctttatcgtttacatccatgcaggtctttacaaatcagacaatatgcatatctttccgatagatcaagcactattcctgcaatgaaggatgatggtattgggtataaggttgacactggaaaagaacctccagtagggaccactacatctactcagaacaagccaatgacctgggaagatatttttattcagcaggaaaatgattcaatttttaaacaaaatgtaacagatggcagtactgagtttgaatttataataccagagtcttactaaactcctttgaaatactagaaagttttgttttggatgatggggcaggggtttcagaagatctgtaaaacaaattaaggtgcgaacaagttaatttgatctgccacattatctgaaggaagtgtagtgggatttttgttgataatttttagaagcaaattttcctgaaagttttgagtagaggtgagaccccctccccaagtatctgtttatatagttagttttcagctcatttaaaagaggcaaaaattaaaagcttggagagatagtttcctgaatagaatttgaagcagtctgaatgttctttgaaaataactggagttattagcataccctagtacatcttacagctttccccttccatgttagcactttactgctgaattctcaattttcttaacattgagacaataaatgtgtgttttgtcttgtatatggcataaagagtaaataagttttagagttgttctggaaaatgtcagaataagtcagtacttgggttgtgtaatctgctagtccaagcgaacagcaacctcctgctaccctccctctatgaaaatagccatgcagacaagtctctcatctgaagaacaaattagatttagctaattagaattaatcctggctttcattgccatagtctgtaaaagactttggtggctagaccactttatacctttgcagtgtggtctctgggggcaaaaaactaatgaaaacaatctctgtaatggcagataggaggagatgaaaagttctgttgcatggatttttaattctctggctaccacatagtagagaatggaatgaagatttccttttggcttcttaaggttaaaaatattcccatgaacatgaaaattttcaaattttgaatctgaaagccaccaaatgtatctttatgtataaatccttgtaaatgatagattccatgggtgagactttacatattttgggtgggaggctactggcatatatttttaaatgttcatattgcgtagaatctccactaggaagtctttatttgaaatagttgaatcagtgatctagtattttcctttcggcaagatttgttaggtttttaccccttctaaaataagttttattccatctgcaaattgctgcaatattatagtaatcagaaactacataaggaatgttatataggcttgtcagttcccatttttcttgacaacaataaataccacttttaaaaatgacacatatttaaacacttagaaaataaagttaacacttactgaagtgctagtactaaactgtgctagtactaaaagaaaacaggttggaacatacatatagcctagcatttataacagaattgttgaacgtctgtaaatgatttttttttttttggcaaaggaaaaaattgatactggaaaagattgttgtgcatagttattagtcatttgtaaccttgcttaagtatttcttagtccaacatagatattttctttctcctgaccatgtattttaaaatatagtctatttcttgactttgaacttaaagctttaatcataatttctcatgtatacatcgttcttctgatggtaagctggatttgaaggtagtggtttcagtgtttcttaagttggtagctgagggtatcaggcatcagttcatgcaataatacaagaaaaaaaatcctttgcttgccaagaggtagagtgatgtgcatttatctgttttctgttctgtaagtctagaccttcaaaccatttgtaaactaacccctgggaaatttgaaattacctgataacttaagactctgtgatctctggaatcaccatatgtttcttttttgtgtagatattaataacattactctttgactatagtgtgcactctgaaatgtactcagtgaaaatttgttttgagtttcattaatgctatttcaccagttagacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaattctgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaagttcagaattcatgtgaaatacttctttggggcaaaagtccttcattcctggtatttattggattggaaatctgtagcaagatgctgtttaaaattaccatattgtttttttatcttatacttagctctctggctattgaacttccttttcttgtttgaagttagcttcaaatttgctcctatgctaaattacctgtaaatattctggataggaactacttgaaatagtaatttgttaaaagatatgacaaaatgaaaatgcttaaactacagaaatttaaaaatgccataacaatcttgcgagactaactttaaaatatactttaaatgattattatgattttggtggtaacgatcccccacacacaaccactatgaagaaataatgccgcatttttcccccattgtaccaaaaagataaaaaaatggtaaacactgatcaaggtattttgtattgtcaaggcatgcatattctaaagaattaaatgctaacttaacagcactggctttctggctggtcaactatatgaaaccttgttcattcctccgagtactgtaatgttcacacttgtacaatcttccctgtcatgactttaagttctacttttcattaaccatggcctgatattagttcttagagcttcttgtggcaaaaataaaatgatttaattctga

SEQ ID NO: 31293 - DNA, 5194 bp, Homo sapiens
agggcgcctttggcttcagcgcttcgcccccgcgctgtgccctctgtcggcggcgtggggcagctgtagcagcgttggcggcaggaggcggcggccgcgtcgacgtcgacccagactggagcgacgtttaaagaaggggcagaatcgctggggagtgcggcttcttcttgttgggggactcccagccttccgcgcgtccggaggaggagaagcggcggcgccgggaagcaggcatggagagtagaaaactgatttctgctacagacattcagtactctggcagtctgctgaactccttgaatgagcaacgtggccatggactcttctgtgatgttaccgttattgtggaagaccgaaaattccgggctcacaagaatattctttcagcttctagtacctacttccatcagctcttctctgttgctgggcaagttgttgaactgagctttataagagcagagatctttgcagaaattctcaattatatctatagttctaaaattgttcgtgttagatcagatttgcttgatgagttaattaaatcagggcagttattaggagtgaaatttatagcagagcttggtgtcccattgtcacaggttaaaagcatctcaggtacagcgcaggatggtaatactgagcctttacctcctgattctggtgacaagaaccttgtaatacagaaatcaaaagatgaagcccaagataatggggctactataatgcctattataacagagtctttttcattatctgccgaagattatgaaatgaaaaagatcattgttaccgattctgatgatgatgatgatgatgtcattttttgctccgagattctgcccacaaaggagactttgccgagtaataacacagtggcacaggtccaatctaacccaggccctgttgctatttcagatgttgcacctagtgctagcaataactcgccccctttaacaaatatcacacctactcagaaacttcctactcctgtgaatcaggcaactttgagccaaacacaaggaagtgaaaaattgttggtatcttcagctccaacacatctgactcccaatattattttgttaaatcagacaccactttctacaccaccaaatgtcagttcttcacttccaaatcatatgccctcttcaatcaatttacttgtgcagaatcagcagacaccaaacagtgctattttaacaggaaacaaggccaatgaagaggaggaggaggaaataatagatgatgatgatgacactattagctccagtcctgactcggccgtcagtaatacatctttggtcccacaggctgatacctcccaaaataccagttttgatggatcattaatacagaagatgcagattcctacacttcttcaagaaccactttccaattccttaaaaatttcagatataattactagaaatactaatgatccaggcgtaggatcaaaacatctaatggagggtcagaagatcattactttagatacagctactgaaattgaaggcttatcgactggttgcaaggtttatgcaaatatcggtgaagatacttatgatatagtgatccctgtcaaagatgaccctgatgaaggggaggccagacttgagaatgaaataccaaaaacgtctggcagcgagatggcaaacaaacgtatgaaagtaaaacatgatgatcactatgagttaatagtagatggaagggtctattatatctgtattgtatgcaaaaggtcatatgtctgtctgacaagcttgcggagacattttaacattcattcttgggagaagaagtatccgtgccgttactgtgagaaggtatttcctcttgcagaatatcgcacaaagcatgaaattcatcacacaggggagcgaaggtatcagtgtttggcctgtggcaaatctttcatcaactatcagtttatgtcttcacatataaagtcagttcatagtcaagatccttctggggactcaaagctttatcgtttacatccatgcaggtctttacaaatcagacaatatgcatatctttccgatagatcaagcactattcctgcaatgaaggatgatggtattgggtataaggttgacactggaaaagaacctccagtagggaccactacatctactcagaacaagccaatgacctgggaagatatttttattcagcaggaaaatgattcaatttttaaacaaaatgtaacagatggcagtactgagtttgaatttataataccagagtcttactaaactcctttgaaatactagaaagttttgttttggatgatggggcaggggtttcagaagatctgtaaaacaaattaaggtgcgaacaagttaatttgatctgccacattatctgaaggaagtgtagtgggatttttgttgataatttttagaagcaaattttcctgaaagttttgagtagaggtgagaccccctccccaagtatctgtttatatagttagttttcagctcatttaaaagaggcaaaaattaaaagcttggagagatagtttcctgaatagaatttgaagcagtctgaatgttctttgaaaataactggagttattagcataccctagtacatcttacagctttccccttccatgttagcactttactgctgaattctcaattttcttaacattgagacaataaatgtgtgttttgtcttgtatatggcataaagagtaaataagttttagagttgttctggaaaatgtcagaataagtcagtacttgggttgtgtaatctgctagtccaagcgaacagcaacctcctgctaccctccctctatgaaaatagccatgcagacaagtctctcatctgaagaacaaattagatttagctaattagaattaatcctggctttcattgccatagtctgtaaaagactttggtggctagaccactttatacctttgcagtgtggtctctgggggcaaaaaactaatgaaaacaatctctgtaatggcagataggaggagatgaaaagttctgttgcatggatttttaattctctggctaccacatagtagagaatggaatgaagatttccttttggcttcttaaggttaaaaatattcccatgaacatgaaaattttcaaattttgaatctgaaagccaccaaatgtatctttatgtataaatccttgtaaatgatagattccatgggtgagactttacatattttgggtgggaggctactggcatatatttttaaatgttcatattgcgtagaatctccactaggaagtctttatttgaaatagttgaatcagtgatctagtattttcctttcggcaagatttgttaggtttttaccccttctaaaataagttttattccatctgcaaattgctgcaatattatagtaatcagaaactacataaggaatgttatataggcttgtcagttcccatttttcttgacaacaataaataccacttttaaaaatgacacatatttaaacacttagaaaataaagttaacacttactgaagtgctagtactaaactgtgctagtactaaaagaaaacaggttggaacatacatatagcctagcatttataacagaattgttgaacgtctgtaaatgatttttttttttttggcaaaggaaaaaattgatactggaaaagattgttgtgcatagttattagtcatttgtaaccttgcttaagtatttcttagtccaacatagatattttctttctcctgaccatgtattttaaaatatagtctatttcttgactttgaacttaaagctttaatcataatttctcatgtatacatcgttcttctgatggtaagctggatttgaaggtagtggtttcagtgtttcttaagttggtagctgagggtatcaggcatcagttcatgcaataatacaagaaaaaaaatcctttgcttgccaagaggtagagtgatgtgcatttatctgttttctgttctgtaagtctagaccttcaaaccatttgtaaactaacccctgggaaatttgaaattacctgataacttaagactctgtgatctctggaatcaccatatgtttcttttttgtgtagatattaataacattactctttgactatagtgtgcactctgaaatgtactcagtgaaaatttgttttgagtttcattaatgctatttcaccagttagacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaattctgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaagttcagaattcatgtgaaatacttctttggggcaaaagtccttcattcctggtatttattggattggaaatctgtagcaagatgctgtttaaaattaccatattgtttttttatcttatacttagctctctggctattgaacttccttttcttgtttgaagttagcttcaaatttgctcctatgctaaattacctgtaaatattctggataggaactacttgaaatagtaatttgttaaaagatatgacaaaatgaaaatgcttaaactacagaaatttaaaaatgccataacaatcttgcgagactaactttaaaatatactttaaatgattattatgattttggtggtaacgatcccccacacacaaccactatgaagaaataatgccgcatttttcccccattgtaccaaaaagataaaaaaatggtaaacactgatcaaggtattttgtattgtcaaggcatgcatattctaaagaattaaatgctaacttaacagcactggctttctggctggtcaactatatgaaaccttgttcattcctcaggccatggttaatgaaaagtagaacttaaagtcatgacagggaagattgtacaagtgtgaacattacagtacccggaggaatgaacaaggtttcatatagttgac

SEQ ID NO: 31294 - DNA, 494 bp, Homo sapiens
cgtaaaggcaactttattaagttacaatttacgtgcaacaaaaacattatgcatgtacagtctgattaatttggacaagacatatgcacctgtgtgactatcaccacaaccaaaatgagaatattttcatcacccctcaaaagttattcaagtctcttaatactgggttcccacccatcaacccacagccctaggcagtcattgatctgctcttcattgatctgctctgtgtcactgtggattagataaaatcattcagtatgtactttatttgtgtaaatttgttttgctcagcatagtgtctgagaaacatcacagatgcaatgatgttgcctgaatcatcgcaagacatcgcttgaatcagtagtagtgttccattaaatgaatatgctacggtttgttattctcctattggtgggtacctgggctctttctggtttggggctacccctatgaataaagtgactatgaacgtttgaatataaatctttgtg

SEQ ID NO: 31295 - DNA, 113 bp, Homo sapiens
ctcaggaaaaactctgccttctgtaagtcttctcttttggttcctcatcctaaaatccactctgatttggagtaaatcatgttaattgtgtagaaactgaattgtaggggccc

SEQ ID NO: 31296 - DNA, 458 bp, Homo sapiens
tggaagaactgaggtttgccaatgctaccaatatccaagccaaaaaccacagcccctcctctcggtccactgtccaggtcttactgcctagggactcctgagttagttaacagagcagggaagaagactgactctgccattaattcacgagtggcctggggccaattcctctctgggcctcaactggaaaaacagagaacttgatcaaaacatctccatttccctttgggcctgggggttacaagctatgataaggatttttccatctctaacattctagaattagaatattctatactttcattcctagaagcagagtgagaacagagaacagggaccttcagtccaggaaacagcagaggccagtcagggcttcctagctgcatcctcaaagcctgtccaccttcagaggctttctcttgcgtctgctgcctcaaaggtggttgcttccccactag

SEQ ID NO: 31297 - DNA, 475 bp, Homo sapiens
ctgatattgattatcttaatcatcaagaggatagacggcaggggtggatggaacgtcacgctttttggcattagctagaaaatcgttaattcttttaagccttttcttcccctctgtgcaccaatcctctcttttctcagggcctaaccacttgtggttaccctagatcggtatgttctgtattatgcaacatttccctcttattttggagcctctgtcatttcgttcgttcagataaattaattgaattattgaacacagaccgtgtgctgggccctgacagtagggccgcgagacacagctgccattttgagcctcatggctttgagatgcttaagaaaactgaaaagtcagctgggcgcttcgggtcacgcctgtaatcccagcactttggaaggctgcggaggatggatcacttgaggtcaggagtgtgagaccagcctggccaacatggtgaaacctcatctctactgaa

SEQ ID NO: 31298 - DNA, 461 bp, Homo sapiens
aaggtgagctaaatttaattttccaatcaataaatgtcagtcacatcagtcacaattcagaacaaaaccatgtttttgcttatttattgacttatttttacagacagggctagaatgcagtggcatgaccatacctcactgcagccttgcgctactgtgcttgtagcctcccaagtagctgggactacacgcacacaccaccgcacccagctaatttgttttttttttttttaagagatgggggtcttgtgctttgttgcccaggcggatctcgaattcctagcttcaagagatcctccggcctcacactcccagagtgctgagattataagcgtgagccactgccccttgcctatttttgctttagaatttgtgtatcctgattaaaaatgaaaacagcaccaaacctcccccattctgtggctttcctaatttggggagtaagatgatttcaagtaaca

SEQ ID NO: 31299 - DNA, 1120 bp, Homo sapiens
aagaacaggatattccccttataaaatattaggccccctcccatattgcggggacttccaggcactccccgagagttaggtgaaattgagttacagtgacagctacaggctctaggaaaaattgcacaaacaatctcagcctgggtaaatgagagatgccctgttagcttattctccccagtttaccctttctccccaggtgatcaagtatggattaaagactggaatgtagcttctttgtgcccatggtggataggaccccagattgtcatcctgaccactctcaccgctgtgaaggtagaaggaatcccagcctggatccaccacagccatgtaaaacctgcagcgcctgaaacctgggaggcaagaccaagcccggacaacccttgcagagtgaccttgaagatgatgacaagccctgctccagtcacacccagaagctgactagtccatgcacggccgaagcatgaggaagctcatcgtggaactcatttttcttaaattttggacttgtacagtaaggacttcaactgaccttcctcagactgaggtagggcaaaaagttaaaacagtctttctgtttaaaagggacttgtgtgtataatgccacccagtacaaggtatgcagctcaggaagtgaccagactcaagtgtgctacaacccagtagaactacttaatccccattggaaaacaagagagtatgtaactctaggagtcaatggaattggactggcaggaagacctaggtaatgtaggtggaagtgagaactcccactagtgagtgaggttctcaaaggggagaatgaggagggaagccatttctcttactgtctcctgtctctgaagaacaggaggaagtaaaagttgaaaaacaacaggaaggaagtcagtggcaagaccagccagtgccactgatgacctggcctgaggttaaaaggttaaccacccccctctcctctaaccacatgtgctctcaatccatcacgaccctttcatgtggaaccccttagagttgtaagcccttaaaagggccaggaactctgtcttcggggagctcggctcttaagatgcgagtctgccaacgctcccagccaaataaaaacctcttccttcttcaa

SEQ ID NO: 31300 - DNA, 569 bp, Homo sapiens
taaccttccttccattcaccttgaggctgttcagttattaattacttttcttattagtccattagccccttttcaagcccaatgttgcttgctcctattttggcaatgctaaccattctttcctgcttaaaatgcttcatgacactgtgctttctaagtgtccctttctcctctttggctggttcttttcagtctccttcaggggctgtacttcctttacctgatccctctcagttcttccttcagagttccaaatcctggctccccgttactctcagtaaataccatccctctggttgaacttaacctacgtattcgttctgtttttgttacacaaatatttaatgagcggctattacgtgacgggttctttttaataagcactggggataaaaacatgcatgactgctgcattagtggtctgattggaaagaatgcaaaatgtgcatggaatcatgaaagcatataatgaggtctggcctggctaatgtgatctgggaaggcttgaggatgtaatcaataagttgtcaatgaaaaaaataaataggagttaactaagtaaaatggga

SEQ ID NO: 31301 - DNA, 536 bp, Homo sapiens
tatcccatctaaattagtcaccctccatcacattatcctcttttttcatcaaagtccttacacctgtctggcaatttcttattaattgatttgtttttggtaaactccacgaaaggtgggagtcatttctcttgtttccattctttccacagcacttagaacagtgcctggcacatggtaggtgctcaatatgtgtttactggatgaattaatgagtgcatgctcatgggcaaggatctcattgtgctggaaaagcagcagagtgagacaaaactggacaggtgagtgaaggtcacaccaagaaggttcttagctgccaaactaaagggtttggatcttactctctggagaaaagggtgtagctagtggttttataggagaggagaggcgcgatccgcacttgagaaggtcaatttggccgctgtgtgtaggtcatattacggagaaaaaaactaaaggctttgagacaatccatgatgtaaagggcttagcacagtgcccagcacgcagtaggtctccagcgagtcgttatcacc

SEQ ID NO: 31302 - DNA, 473 bp, Homo sapiens
caggctctgtccctccacttaggtgttaagggactcagtcaaggatgtttacatgtgcctcagagatttttttgggtacccagcagtgtagagttctagaaagttcttttcagtttacaaatgccagttcttttctgctagtctttggcagtgattgaatgtgaattgtgaaatttgattgtggtctcactccaagttctattttatttctggtggagctggaatgttttatctttctcggaaacgatcactttttgtgtgtatggcaacaaaacagctagaataactgtcacttgggctcagcaagtacacaaaagtatgggctgggggcattttaaccaatccatattcatacacaggtaagctattccacttactgcaaactctccagaattgaaatcccagcagatttaatacacaaagcctcttcagtcctagggaaatgagtttttttttaacagactgattattca

SEQ ID NO: 31303 - DNA, 376 bp, Homo sapiens
aggggccaccccagccgcactggttcccagagagtgacctgggtgtgtgagcagggaggccaagctgaccaagagcctcagcacacccccagcacctgctgtgagcaagctgcatggcttccccaagtgtggatgcgatgacatcatgggtatttacagattccttttcactgtgtcccaggctctcctggttcatgtgtgatacactgcacttggggtggaggtgtgctgacagttgtaaagggccgagcctttctttcccgtggctctgatgcacagtttccagataccagtcatgaaggaagttcttgagattatggactttgtcctagtcacatagggctgctaggacaaagtgccatagacttgggggtgg

SEQ ID NO: 31304 - DNA, 440 bp, Homo sapiens
ttttcccatctctaacttcctatctgcaactcaaagttcaccctggagcatcgcatctacagcacagataatccaagccgtgtgttttctgctcaactcttctctcaaacgcaaacttcctatcctgcaaaaagcattacagattgtttatctgtccaaacaagttatgaggctggttataatatactttactaccagctgttttccttaacgtttcactctcctgaagacaatcatttccttcttgtaacagatagagtatttctcaagctcccaatgctgtttgtaccccctattaagcatttccataaacacagcaaattaatcatgaccaaattgggattttctattatttctataaaatctgtatcttctctccctccattctctatctcagagaatggcacgttatccatctaagcattcagtgtctccactag

SEQ ID NO: 31305 - DNA, 372 bp, Homo sapiens
ttccacctgttgattgacagaagataaaagactccagttgtgatgaaaaattaccggggaaattgcagtctctacacaaatgcaatgccttttatgtttgcagcccatgaatggatgtactgctgcttttatgtaaaagacatcaattaccaaaagctcctctagttaaactaaatttgactttgagaattaactgcatttgttctttcaatagatgcttggggaataaagttgtaatgacctttctgggggtgtaaaaaaaatcagatgccagaagattgaaattgaacaaagatgacattcggcctgaaataattgggccatgcatcagcaaacaaaaaacaaaaagcaaaatcagtggcttgagttatt

SEQ ID NO: 31306 - DNA, 415 bp, Homo sapiens
gaatgccatcagtgatcaactcattcatgaaacttgttttggactgtttattttgaaaattttcagcttgataatatctgtgtacttaaagtcttgaaaaagttgccatgttaatattctcttacatattaaatgcatcatctcatttaatcttcacaaaaaacctgactctaggtatacatacgtttttcagtttaatatatgagggattgagggtcagacaggatcaatgatctgactctcgtcccagagctaataaaaaatgacacaaggattttaatccatgtttctctaacacaaaagtcagtgctttccactatccctcccagcatgatgcaggacaagagtaaagggcaatcttagcggaattaaaatcctaaagatccaggggatatgacctacgacgtagctgtag

SEQ ID NO: 31307 - DNA, 382 bp, Homo sapiens
agtttttcactctcccagcacaacccagcaaccaccacatctatgtgatgtacaagagaagagaaagtgaaaagaaacttttcaagagagagtgctgcagcagacctcgcctttgtcctgagggttctcaactggttcttgaatattccagagagaccatagccagattgccttgtgcccaagccaggcttggcttgtagaccagggaagggaaaacaaattacctcccctcctctacccctccctttgggttggaggtatgcctgaacccgtgctctgcaggctgtgtgttgctttaatagaggaattctgattagggagggggacaggaaagggaccaaggaaagtacattggttacaatgctggctaaacaaggcccca

SEQ ID NO: 31308 - DNA, 678 bp, Homo sapiens
aggagttgtctgaaaagtaacacagagagggagggtaagggagttgagtatatttctgaagaagtgattataatggtggaccttatgtgtactcatggatattgacagcgtaattttgaaattaaggagggtttttttttactgattttttcaccatatctctatttatttgaattaaactttgtagttaagtattgtaaattttgttcttttaaaagaatcatataatccctgactgtactctaaaaagaccgaaaaatttataaaatctacaaattcttatttgtatacctgtttcctcactgaccagtcaatgtcagtgtcaatcactttaatgtattttgctggtttagtaagtgtgtgacagtgatgtacgttgttttactttgcttgattatgaatgctagtagtggtgaggcttttatccatgaagactcgctgtctgcattttcccctagaatcagggcataaattctacatgattgcatcaaaatagtttatcttttggataatgagctccattagttgtgtttgtttaacctacatttttttattctgttatttcttcttaattatatttttgggcaactttttagaaatttgcatttaaattggctctattcttttttataatataatctccatgtcttaaatacacagaaatttgtttaatatgag

SEQ ID NO: 31309 - DNA, 702 bp, Homo sapiens
gctgactgatcggctcgttataaataattctcacctattcctaaaagcgggggcctgttgtgcacttgctacctccgtttagagaatattgcacttcaagcccattggatttgaaagtaatagaaatggtctttttaaagccaatattctagaatgagcacttcattaaatcgagacccaccttttacccaaatttagctagactttaatgtgcatcacacatctctaatctgggcttttcctatagcctctttcaaaggacatatttgttcagccttatcagtgaggtattcaatcatgcttcccttgtatcaggcacctcaagggcaggagctaacacaaatgtgcttggtttttaatagctgaaaatatgtctacgtgaggttaactgtatttacccaatgccagatacctgaaagagtgtgaaaaattaaggtaattattaatgtctccaaatagctggatgatggtgtcatatttgcaatgcatagattatgccatcatgtcagatttgggacactttgggaggttgggaatgggatggggatgggtggcagtgaataacatcagacagggtggatacgtaattccaaagttggaattagtgtctctattttaacagcaattcctttacttaacagcaattcttttctgtttatcattttagggaaaactagaaaatacagaaatatatcaagaaga

SEQ ID NO: 31310 - DNA, 2286 bp, Homo sapiens
tggatatgcaaatgataggaggactgaaaatcataatccttcagccgtgatggcgtcaacgtcactattcttggaacaagccatttttaccagagatgtctccaagagcaccagcaaccccagctatctggatctgaagtggatatgctcagagacatcctggcccaccccaaagaagatgctgctgcactcagaagacgccagagctagccaccacccacactgcaagtctggaagctctgcaaggacccagcaaggcagcctgctcagcgaaggctttgtctcctgtggcaggaagagcaacattaagaacaagaaccccgggctggactacccctgagatttaatgaccagagctgagacccccaagaccacaatgactatggagggctgtcattaccctgcctgaccctctaatgcctctcagttcaaggaggccactgagtgaaactgaaggctggttttccttggaagccagcggcccatccacctgctccacttccctgcctcttgcagcctccgctcaaacactgtcgtggcttggcagcactacaaggcagagtgaaaacagatacttctacccacattcctatctcctctcatttacgcagattaaatgctttctttccttgttttacactgctaggattttcatcaccctgttttttctttctctacatcagctacaagaaaaaaaaaaggagttactgagcaactaagaagtcacaactgttttcagttttattaatgagttgttatacttattttatagatagagaattaccattataacattgctccattgcccactcatccattcacgcatctgtccatccgtccatccacccatttgtccactccccaaatggtcatcaattgtctactgtgagccaagcaaagtgctccttactttggactctgaatccagtgctctttctacttcaccatagacacatgccccttgagtataagggagcttgattcattcaacaaatatctgttgtccatctccaatgtactggcatattctaaatgcatccaacaaaaaccaaaatgaaaaaaaagaaaaacccattccttcaaggggattgcattcggactgggggagacagataaaataaaaataatgaagtcaaatatatatgttagtgacatgtgccatgaagaataatgcccaataggtaaatggggcaattaacaaacgtaatgtaaataaattagttccaagaaatcattgactcaccaacagagggaacacaatttggtccatggtaaaatattccttggtattaataatttcttctcctaaagtatttcaggggctgccaagctgctctcctgtttcctcttccttggggctgattgcatcccatgatgtgcccaggttttgagatgctcctcgtgaatgaaaataggactgtctggttcctccatccatagcaagggagcctagacagaaataacttctgtgcatttctccagctacatttagctgaaaatatgtctacgtgaggttaactgtatttacccaatgccagatacctgaaagagtgtgaaaaattaaggtaattattaatgtctccaaatagctggatgatggtgtcatatttgcaatgcatagattatgccatcatgtcagatttgggacactttgggaggttgggaatgggatggggatgggtggcagtgaataacatcagacagggtggatacgtaattccaaagttggaattagtgtctctattttaacagcaattcctttacttaacagcaattcttttctgtttatcattttagggaaaactagaaaatacagaaatatatcaagaagaaaaaaaatttaaaaatgacccaaaatcccaccaaccagagacagctattaatgattgtggtatatttattgtaagtctctttatttctgtcttcatgcaaacacatttttaaagaatggacactggtattatattgtttatacaactctaaatgctgctttttcacttattacaattaggacttttttcatgttaataaatacttcctgaaaacataaatatctaatggttacatcaaaatttattaccttttccttgttgatgaacatttaggttgctttcattttttcttgcttatataaaataaacattcttgaacataaatacatgttaacagctctgaaaattactccatgcccttattctttttctttctttctttctttttttttttttttttttgagacagggtctcactctgtcacccaggctggaatacaatggcatgatctct

SEQ ID NO: 31311 - DNA, 2054 bp, Homo sapiens
tggatatgcaaatgataggaggactgaaaatcataatccttcagccgtgatggcgtcaacgtcactattcttggaacaagccatttttaccagagatgtctccaagagcaccagcaaccccagctatctggatctgaagtggatatgctcagagacatcctggcccaccccaaagaagatgctgctgcactcagaagacgccagagctagccaccacccacactgcaagtctggaagctctgcaaggacccagcaaggcagcctgctcagcgaaggctttgtctcctgtggcaggaagagcaacattaagaacaagaaccccgggctggactacccctgagatttaatgaccagagctgagacccccaagaccacaatgactatggagggctgtcattaccctgcctgaccctctaatgcctctcagttcaaggaggccactgagtgaaactgaaggctggttttccttggaagccagcggcccatccacctgctccacttccctgcctcttgcagcctccgctcaaacactgtcgtggcttggcagcactacaaggcagagtgaaaacagatacttctacccacattcctatctcctctcatttacgcagattaaatgctttctttccttgttttacactgctaggattttcatcaccctgttttttctttctctacatcagctacaagaaaaaaaaaaggagttactgagcaactaagaagtcacaactgttttcagttttattaatgagttgttatacttattttatagatagagaattaccattataacattgctccattgcccactcatccattcacgcatctgtccatccgtccatccacccatttgtccactccccaaatggtcatcaattgtctactgtgagccaagcaaagtgctccttactttggactctgaatccagtgctctttctacttcaccatagacacatgccccttgagtataagggagcttgattcattcaacaaatatctgttgtccatctccaatgtactggcatattctaaatgcatccaacaaaaaccaaaatgaaaaaaaagaaaaacccattccttcaaggggattgcattcggactgggggagacagataaaataaaaataatgaagtcaaatatatatgttagtgacatgtgccatgaagaataatgcccaataggtaaatggggcaattaacaaacgtaatgtaaataaattagttccaagaaatcattgactcaccaacagagggaacacaatttggtccatggtaaaatattccttggtattaataatttcttctcctaaagtatttcaggggctgccaagctgctctcctgtttcctcttccttggggctgattgcatcccatgatgtgcccaggttttgagatgctcctcgtgaatgaaaataggactgtctggttcctccatccatagcaagggagcctagacagaaataacttctgtgcatttctccagctacatttagctgaaaatatgtctacgtgaggttaactgtatttacccaatgccagatacctgaaagagtgtgaaaaattaagggaaaactagaaaatacagaaatatatcaagaagaaaaaaaatttaaaaatgacccaaaatcccaccaaccagagacagctattaatgattgtggtatatttattgtaagtctctttatttctgtcttcatgcaaacacatttttaaagaatggacactggtattatattgtttatacaactctaaatgctgctttttcacttattacaattaggacttttttcatgttaataaatacttcctgaaaacataaatatctaatggttacatcaaaatttattaccttttccttgttgatgaacatttaggttgctttcattttttcttgcttatataaaataaacattcttgaacataaatacatgttaacagctctgaaaattactccatgcccttattctttttctttctttctttctttttttttttttttttttgagacagggtctcactctgtcacccaggctggaatacaatggcatgatctct

SEQ ID NO: 31312 - DNA, 2411 bp, Homo sapiens
tggatatgcaaatgataggaggactgaaaatcataatccttcagccgtgatggcgtcaacgtcactattcttggaacaagccatttttaccagagatgtctccaagagcaccagcaaccccagctatctggatctgaagtggatatgctcagagacatcctggcccaccccaaagaagatgctgctgcactcagaagacgccagagctagccaccacccacactgcaagtctggaagctctgcaaggacccagcaaggcagcctgctcagcgaaggctttgtctcctgtggcaggaagagcaacattaagaacaagaaccccgggctggactacccctgagatttaatgaccagagctgagacccccaagaccacaatgactatggagggctgtcattaccctgcctgaccctctaatgcctctcagttcaaggaggccactgagtgaaactgaaggctggttttccttggaagccagcggcccatccacctgctccacttccctgcctcttgcagcctccgctcaaacactgtcgtggcttggcagcactacaaggcagagtgaaaacagatacttctacccacattcctatctcctctcatttacgcagattaaatgctttctttccttgttttacactgctaggattttcatcaccctgttttttctttctctacatcagctacaagaaaaaaaaaaggagttactgagcaactaagaagtcacaactgttttcagttttattaatgagttgttatacttattttatagatagagaattaccattataacattgctccattgcccactcatccattcacgcatctgtccatccgtccatccacccatttgtccactccccaaatggtcatcaattgtctactgtgagccaagcaaagtgctccttactttggactctgaatccagtgctctttctacttcaccatagacacatgccccttgagtataagggagcttgattcattcaacaaatatctgttgtccatctccaatgtactggcatattctaaatgcatccaacaaaaaccaaaatgaaaaaaaagaaaaacccattccttcaaggggattgcattcggactgggggagacagataaaataaaaataatgaagtcaaatatatatgttagtgacatgtgccatgaagaataatgcccaataggtaaatggggcaattaacaaacgtaatgtaaataaattagttccaagaaatcattgactcaccaacagagggaacacaatttggtccatggtaaaatattccttggtattaataatttcttctcctaaagtatttcaggggctgccaagctgctctcctgtttcctcttccttggggctgattgcatcccatgatgtgcccaggttttgagatgctcctcgtgaatgaaaataggactgtctggttcctccatccatagcaagggagcctagacagaaataacttctgtgcatttctccagctacatttagctgaaaatatgtctacgtgaggttaactgtatttacccaatgccagatacctgaaagagtgtgaaaaattaaggtaattattaatgtctccaaatagctggatgatggtgtcatatttgcaatgcatagattatgccatcatgtcagatttgggacactttgggaggttgggaatgggatggggatgggtggcagtgaataacatcagacagggtggatacgtaattccaaagttggaattagtgtctctattttaacagcaattcctttacttaacagcaattcttttctgtttatcattttagggaaaactagaaaatacagaaatatatcaagaagaaaaaaaatttaaaaatgacccaaaatcccaccaaccagagacagctattaatgattgtggtatatttattgaatttactaaagtcatgctatacgctaggcactgtggagggactgcagaaagacttcaaggactgcaccgtcttgttagaaagatgcctagacaacatttgagaaacgctgatcatgtctgatgacacataactgctaacagttacatggaattttctatatgctatatacaaacatacaaatatatgtatgtatatttactcagctctcacaacagctactactgttattatgaatcctgttttatagtgagaaaactgaaacatggagaggttaagtaatttgcccaagatcacatagctactaagtggtggaactgtgattagaatccaggcattcaggctccagagttcatactcttcacataccacatctatcttgaatataacaatgtagagaaaaagaattatagcaagcatatgtctaggtaagcattttccagaagtgactgtttttttgcattgggtttgtaaactttcaacaataaagcaggttggactttaaaaaa

SEQ ID NO: 31313 - DNA, 1981 bp, Homo sapiens
tggatatgcaaatgataggaggactgaaaatcataatccttcagccgtgatggcgtcaacgtcactattcttggaacaagccatttttaccagagatgtctccaagagcaccagcaaccccagctatctggatctgaagtggatatgctcagagacatcctggcccaccccaaagaagatgctgctgcactcagaagacgccagagctagccaccacccacactgcaagtctggaagctctgcaaggacccagcaaggcagcctgctcagcgaaggctttgtctcctgtggcaggaagagcaacattaagaacaagaaccccgggctggactacccctgagatttaatgaccagagctgagacccccaagaccacaatgactatggagggctgtcattaccctgcctgaccctctaatgcctctcagttcaaggaggccactgagtgaaactgaaggctggttttccttggaagccagcggcccatccacctgctccacttccctgcctcttgcagcctccgctcaaacactgtcgtggcttggcagcactacaaggcagagtgaaaacagatacttctacccacattcctatctcctctcatttacgcagattaaatgctttctttccttgttttacactgctaggattttcatcaccctgttttttctttctctacatcagctacaagaaaaaaaaaaggagttactgagcaactaagaagtcacaactgttttcagttttattaatgagttgttatacttattttatagatagagaattaccattataacattgctccattgcccactcatccattcacgcatctgtccatccgtccatccacccatttgtccactccccaaatggtcatcaattgtctactgtgagccaagcaaagtgctccttactttggactctgaatccagtgctctttctacttcaccatagacacatgccccttgagtataagggagcttgattcattcaacaaatatctgttgtccatctccaatgtactggcatattctaaatgcatccaacaaaaaccaaaatgaaaaaaaagaaaaacccattccttcaaggggattgcattcggactgggggagacagataaaataaaaataatgaagtcaaatatatatgttagtgacatgtgccatgaagaataatgcccaataggtaaatggggcaattaacaaacgtaatgtaaataaattagttccaagaaatcattgactcaccaacagagggaacacaatttggtccatggtaaaatattccttggtattaataatttcttctcctaaagtatttcaggggctgccaagctgctctcctgtttcctcttccttggggctgattgcatcccatgatgtgcccaggttttgagatgctcctcgtgaatgaaaataggactgtctggttcctccatccatagcaagggagcctagacagaaataacttctgtgcatttctccagctacatttagggaaaactagaaaatacagaaatatatcaagaagaaaaaaaatttaaaaatgacccaaaatcccaccaaccagagacagctattaatgattgtggtatatttattgtaagtctctttatttctgtcttcatgcaaacacatttttaaagaatggacactggtattatattgtttatacaactctaaatgctgctttttcacttattacaattaggacttttttcatgttaataaatacttcctgaaaacataaatatctaatggttacatcaaaatttattaccttttccttgttgatgaacatttaggttgctttcattttttcttgcttatataaaataaacattcttgaacataaatacatgttaacagctctgaaaattactccatgcccttattctttttctttctttctttctttttttttttttttttttgagacagggtctcactctgtcacccaggctggaatacaatggcatgatctct

SEQ ID NO: 31314 - DNA, 1976 bp, Homo sapiens
tggatatgcaaatgataggaggactgaaaatcataatccttcagccgtgatggcgtcaacgtcactattcttggaacaagccatttttaccagagatgtctccaagagcaccagcaaccccagctatctggatctgaagtggatatgctcagagacatcctggcccaccccaaagaagatgctgctgcactcagaagacgccagagctagccaccacccacactgcaagtctggaagctctgcaaggacccagcaaggcagcctgctcagcgaaggctttgtctcctgtggcaggaagagcaacattaagaacaagaaccccgggctggactacccctgagatttaatgaccagagctgagacccccaagaccacaatgactatggagggctgtcattaccctgcctgaccctctaatgcctctcagttcaaggaggccactgagtgaaactgaaggctggttttccttggaagccagcggcccatccacctgctccacttccctgcctcttgcagcctccgctcaaacactgtcgtggcttggcagcactacaaggcagagtgaaaacagatacttctacccacattcctatctcctctcatttacgcagattaaatgctttctttccttgttttacactgctaggattttcatcaccctgttttttctttctctacatcagctacaagaaaaaaaaaaggagttactgagcaactaagaagtcacaactgttttcagttttattaatgagttgttatacttattttatagatagagaattaccattataacattgctccattgcccactcatccattcacgcatctgtccatccgtccatccacccatttgtccactccccaaatggtcatcaattgtctactgtgagccaagcaaagtgctccttactttggactctgaatccagtgctctttctacttcaccatagacacatgccccttgagtataagggagcttgattcattcaacaaatatctgttgtccatctccaatgtactggcatattctaaatgcatccaacaaaaaccaaaatgaaaaaaaagaaaaacccattccttcaaggggattgcattcggactgggggagacagataaaataaaaataatgaagtcaaatatatatgttagtgacatgtgccatgaagaataatgcccaatagtatttcaggggctgccaagctgctctcctgtttcctcttccttggggctgattgcatcccatgatgtgcccaggttttgagatgctcctcgtgaatgaaaataggactgtctggttcctccatccatagcaagggagcctagacagaaataacttctgtgcatttctccagctacatttagggaaaactagaaaatacagaaatatatcaagaagaaaaaaaatttaaaaatgacccaaaatcccaccaaccagagacagctattaatgattgtggtatatttattgaatttactaaagtcatgctatacgctaggcactgtggagggactgcagaaagacttcaaggactgcaccgtcttgttagaaagatgcctagacaacatttgagaaacgctgatcatgtctgatgacacataactgctaacagttacatggaattttctatatgctatatacaaacatacaaatatatgtatgtatatttactcagctctcacaacagctactactgttattatgaatcctgttttatagtgagaaaactgaaacatggagaggttaagtaatttgcccaagatcacatagctactaagtggtggaactgtgattagaatccaggcattcaggctccagagttcatactcttcacataccacatctatcttgaatataacaatgtagagaaaaagaattatagcaagcatatgtctaggtaagcattttccagaagtgactgtttttttgcattgggtttgtaaactttcaacaataaagcaggttggactttaaaaaa

SEQ ID NO: 31315 - DNA, 772 bp, Homo sapiens
tggatatgcaaatgataggaggactgaaaatcataatccttcagccgtgatggcgtcaacgtcactattcttggaacaagccatttttaccagagatgtctccaagagcaccagcaaccccagctatctggatctgaagtggatatgctcagagacatcctggcccaccccaaagaagatgctgctgcactcagaagacgccagagctagccaccacccacactgcaagtctggaagctctgcaaggacccagcaaggcagcctgctcagcgaaggctttgtctcctgtggcaggaagagcaacattaagaacaagaaccccgggctggactacccctgagatttaatgaccagagctgagacccccaagaccacaatgactatggagggctgtcattaccctgcctgaccctctaatgcctctcagttcaaggaggccactgagtgaaactgaaggctggttttccttggaagccagcggcccatccacctgctccacttccctgcctcttgcagcctccgctcaaacactgtcgtggcttggcagcactacaagtatttcaggggctgccaagctgctctcctgtttcctcttccttggggctgattgcatcccatgatgtgcccaggttttgagatgctcctcgtgaatgaaaataggactgtctggttcctccatccatagcaagggagcctagacagaaataacttctgtgcatttctccagctacatttagggaaaactagaaaatacagaaatatatcaagaaga

SEQ ID NO: 31316 - DNA, 1156 bp, Homo sapiens
gctgactgatcggctcgttataaataattctcacctattcctaaaagcgggggcctgttgtgcacttgctacctccgtttagagaatattgcacttcaagcccattggatttgaaagtaatagaaatggtctttttaaagccaatattctagaatgagcacttcattaaatcgagacccaccttttacccaaatttagctagactttaatgtgcatcacacatctctaatctgggcttttcctatagcctctttcaaaggacatatttgttcagccttatcagtgaggtattcaatcatgcttcccttgtatcaggcacctcaagggcaggagctaacacaaatgtgcttggtttttaatagctgaaaatatgtctacgtgaggttaactgtatttacccaatgccagatacctgaaagagtgtgaaaaattaaggtaattattaatgtctccaaatagctggatgatggtgtcatatttgcaatgcatagattatgccatcatgtcagatttgggacactttgggaggttgggaatgggatggggatgggtggcagtgaataacatcagacagggtggatacgtaattccaaagttggaattagtgtctctattttaacagcaattcctttacttaacagcaattcttttctgtttatcattttagggaaaactagaaaatacagaaatatatcaagaagaaaaaaaatttaaaaatgacccaaaatcccaccaaccagagacagctattaatgattgtggtatatttattgtaagtctctttatttctgtcttcatgcaaacacatttttaaagaatggacactggtattatattgtttatacaactctaaatgctgctttttcacttattacaattaggacttttttcatgttaataaatacttcctgaaaacataaatatctaatggttacatcaaaatttattaccttttccttgttgatgaacatttaggttgctttcattttttcttgcttatataaaataaacattcttgaacataaatacatgttaacagctctgaaaattactccatgcccttattctttttctttctttctttctttttttttttttttttttgagacagggtctcactctgtcacccaggctggaatacaatggcatgatctct

SEQ ID NO: 31317 - DNA, 212 bp, Homo sapiens
ttcagtgagtccacagttttggttttacaagatgaaaaaattctagagatctgttgcataacaatgtgaacatattaacactactgaactgtatggttaagatgataacttttatgttacgtggtttttttaaccacattaaaaaaaaccctaaaaagacacaacatacaaatgcaacatatgaaccttgatcaactcctcgtttaaaaata

SEQ ID NO: 31318 - DNA, 270 bp, Homo sapiens
  misc_feature (21)..(21): n is a, c, g, or t
  misc_feature (24)..(24): n is a, c, g, or t
agaccacccgtatccgccagngantccaagagctcaaggccagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaatccagcatcaggtggg

SEQ ID NO: 31319 - DNA, 305 bp, Homo sapiens
atataatggaagtttgtgataattccttagcagtaatgtaaaattattaagttttggccaggcgctgtggctcacgcctgtaatcctagcactttgggaggccaaggcaggcagatcacctgaggtcaggagttcaagaccagcctggccaacatggtgaaaccctgtctctactaaaaatacaaaaaagtagccgggcgtggtggcatgtccctgtaatctcagctacccgggaggctcaggcaggagaatcgctggaacccaggaggcagaggctgccgttagctgagatcgtgctcctgcac

SEQ ID NO: 31320 - DNA, 3313 bp, Homo sapiens
  misc_feature (1714)..(1714): n is a, c, g, or t
ttagggacagcaaaaagtttccaattactgccaactcctagtgatcgacctggaatgtgtttcaaacagctgctcatgtagctataccctctttctcccatttcatcctaagcatttgcctcagaagcataaaatctcttgagagttgtatccagagttaccaagctctcagctatcaaatctgcttcagtctcattttcttcttgtaaattagtcatttgaacccccaaactgacagaataggagactaaagcccaaaaaggggaagggctggcctatgggcagttgcactctgtagaccccaggctactgcttaccagccaagcattctaccttcttacggctgcaactgttaaaggctacttaggcctttctattggatgaaggagcatgcagttacgtgtatattcactgagcaaaatacttgattgtagaatccatgaaatttttttttttttaatttcaagaagaggccttcacagtctctcaagtatgggatggctgtggacaaatactgccaattcagctaactgctgcctggatgttgctttgagtttgatttttgctccatacttaactaaaacaactagcattcacgtagacatgttaaaatactttccccttccccaacagtggttccttccacagacagtgactaatggttttttcttttggggagagggtggcatacaacatagaggcttgaaccaaaggcctctgcaatgttgtcacactcatgaggatgaatggtcctttccgcctacacacagaggggcaagggcttcaagctctttctttccttgactgtgttatcagctttacaaattaacaccatgctagtttgatcctgctagaagtacaggaaggcagaaatggaggattaggagaattactcatcttttggatgaacagtttccaaatcccatttggcacatcactctagactggtaaaggggaggctgacactgaggccacagacccaactggctctaggacatcacgttgttcagtcctttgcttatctaatcatttgtgttcttacccagtgctcactaggtcacccacatagccacttcccctcccagcaaaagttcccagtttaggcacctgtctgggatcatccagtatccaagcttaggggtgaagggagggagcagagaactagtctcaactggttcgttggtatataggtctcttctcaatgttcctaaagtgcatgcagtggcatccccctcaaggcctggctccatgattctgagaggactagaatcaggacagtcagatctgtggtcacatcctgcccaattccagctctgaggtccatcaaaccatctgcttctcccttggcaagaagctccctctgtctgactggcagcagggtcagtggccatccttttctaccttcagctgttgtgcatctcctccacgttttcctggagtaaaggaacaagcaggttcttatccaaatacccaacctgtgaagatgagacggcccttgggaagaggtattagccaagttttcagtatgatgcccggcagaaagaatttgttgtctttgtcttaagcttattatcctcccaggtcataggaagatctaaagtccaatcagtctccttactcagaattcacagctttcccctcaaacttaaaatgcccatgtcatttcacgagtacccataactacccatcgtttagatacatgtcctcccttggnctagaaatctgcagcagttcctacttaaactgatggatgctttgggctttggaggtatctcatccctatgcctgttgccctgaagctgccggaaggaaaggccccactcaactactgggaagaaagcccataattcaaggcttttaatacagtcactacacaagctctccctctgatttaggagatcttgttacctcctcatctacatgtgcttaaaaacaaaaagaaacctataattattcaattcacctgtggtccaaataagtctcacatccagccattcccctgagagggcaggaggccagactttgaactttccacagctgggtcttcattttactagtgagataaagaggtgcagattagggtgacagtccatctaagcaagtggacgatctggggaactgtaggccttgctgaagcatcctcccacagaaaggagataagggccttatccaattggctgtacacaatagatcagtgcttctttcctagacaaggctgaaaggggccaacattatttctgaagacttcattattggaattctatgggagtgatctcactgagctattttggaatagaaatgtggctagttgcctgacctccctcaatggtttcacgtggctttcaaagggaaggaagggcagtgctgacttttggtaaaatgggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccaggtaaggagggaaggatacttatgtgtgtgtgtggagtgtggagatgatagtggtggtggaacttgaaagctagattcagtcctgaggaatggttcctctgttctgagtctacagcatctgcggaatggaatgatcactcttccaaggtgtgcagcagggtgtcaacactttcatatctgaatgtctttgcccttacagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattg

SEQ ID NO: 31321 - DNA, 3254 bp, Homo sapiens
  misc_feature (1714)..(1714): n is a, c, g, or t
ttagggacagcaaaaagtttccaattactgccaactcctagtgatcgacctggaatgtgtttcaaacagctgctcatgtagctataccctctttctcccatttcatcctaagcatttgcctcagaagcataaaatctcttgagagttgtatccagagttaccaagctctcagctatcaaatctgcttcagtctcattttcttcttgtaaattagtcatttgaacccccaaactgacagaataggagactaaagcccaaaaaggggaagggctggcctatgggcagttgcactctgtagaccccaggctactgcttaccagccaagcattctaccttcttacggctgcaactgttaaaggctacttaggcctttctattggatgaaggagcatgcagttacgtgtatattcactgagcaaaatacttgattgtagaatccatgaaatttttttttttttaatttcaagaagaggccttcacagtctctcaagtatgggatggctgtggacaaatactgccaattcagctaactgctgcctggatgttgctttgagtttgatttttgctccatacttaactaaaacaactagcattcacgtagacatgttaaaatactttccccttccccaacagtggttccttccacagacagtgactaatggttttttcttttggggagagggtggcatacaacatagaggcttgaaccaaaggcctctgcaatgttgtcacactcatgaggatgaatggtcctttccgcctacacacagaggggcaagggcttcaagctctttctttccttgactgtgttatcagctttacaaattaacaccatgctagtttgatcctgctagaagtacaggaaggcagaaatggaggattaggagaattactcatcttttggatgaacagtttccaaatcccatttggcacatcactctagactggtaaaggggaggctgacactgaggccacagacccaactggctctaggacatcacgttgttcagtcctttgcttatctaatcatttgtgttcttacccagtgctcactaggtcacccacatagccacttcccctcccagcaaaagttcccagtttaggcacctgtctgggatcatccagtatccaagcttaggggtgaagggagggagcagagaactagtctcaactggttcgttggtatataggtctcttctcaatgttcctaaagtgcatgcagtggcatccccctcaaggcctggctccatgattctgagaggactagaatcaggacagtcagatctgtggtcacatcctgcccaattccagctctgaggtccatcaaaccatctgcttctcccttggcaagaagctccctctgtctgactggcagcagggtcagtggccatccttttctaccttcagctgttgtgcatctcctccacgttttcctggagtaaaggaacaagcaggttcttatccaaatacccaacctgtgaagatgagacggcccttgggaagaggtattagccaagttttcagtatgatgcccggcagaaagaatttgttgtctttgtcttaagcttattatcctcccaggtcataggaagatctaaagtccaatcagtctccttactcagaattcacagctttcccctcaaacttaaaatgcccatgtcatttcacgagtacccataactacccatcgtttagatacatgtcctcccttggnctagaaatctgcagcagttcctacttaaactgatggatgctttgggctttggaggtatctcatccctatgcctgttgccctgaagctgccggaaggaaaggccccactcaactactgggaagaaagcccataattcaaggcttttaatacagtcactacacaagctctccctctgatttaggagatcttgttacctcctcatctacatgtgcttaaaaacaaaaagaaacctataattattcaattcacctgtggtccaaataagtctcacatccagccattcccctgagagggcaggaggccagactttgaactttccacagctgggtcttcattttactagtgagataaagaggtgcagattagggtgacagtccatctaagcaagtggacgatctggggaactgtaggccttgctgaagcatcctcccacagaaaggagataagggccttatccaattggctgtacacaatagatcagtgcttctttcctagacaaggctgaaaggggccaacattatttctgaagacttcattattggaattctatgggagtgatctcactgagctattttggaatagaaatgtggctagttgcctgacctccctcaatggtttcacgtggctttcaaagggaaggaagggcagtgctgacttttggtaaaatgggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccaggtaaggagggaaggatacttatgtgtgtgtgtggagtgtggagatgatagtggtggtggaacttgaaagctagattcagtcctgaggaatggttcctctgttctgagtctacagcatctgcggaatggaatgatcactcttccaaggtgtgcagcagggtgtcaacactttcatatctgaatgtctttgcccttacagatagatggctccccaataccagaagtgagttcggcaaagagaaggccacggagaatgaccccattttggagaggggtttccctcaggcctattggagcctcctgccgggatgattctgagtgtatcacaaggctatgcaggtactccctgaacctgggagcagggttgggccagagagccctgggaagctgggcagaggagtgacaaggggacacatgaacctaagaataaagctgggatggaggagttctagactgagactgggagctccatggaaaatcccttaggagttaggagccaagaacagctctatgtgggtaccatgaaagaaggaaggaaatgcagcataggtggccctggtcattcc

SEQ ID NO: 31322 - DNA, 3597 bp, Homo sapiens
  misc_feature (1714)..(1714): n is a, c, g, or t
ttagggacagcaaaaagtttccaattactgccaactcctagtgatcgacctggaatgtgtttcaaacagctgctcatgtagctataccctctttctcccatttcatcctaagcatttgcctcagaagcataaaatctcttgagagttgtatccagagttaccaagctctcagctatcaaatctgcttcagtctcattttcttcttgtaaattagtcatttgaacccccaaactgacagaataggagactaaagcccaaaaaggggaagggctggcctatgggcagttgcactctgtagaccccaggctactgcttaccagccaagcattctaccttcttacggctgcaactgttaaaggctacttaggcctttctattggatgaaggagcatgcagttacgtgtatattcactgagcaaaatacttgattgtagaatccatgaaatttttttttttttaatttcaagaagaggccttcacagtctctcaagtatgggatggctgtggacaaatactgccaattcagctaactgctgcctggatgttgctttgagtttgatttttgctccatacttaactaaaacaactagcattcacgtagacatgttaaaatactttccccttccccaacagtggttccttccacagacagtgactaatggttttttcttttggggagagggtggcatacaacatagaggcttgaaccaaaggcctctgcaatgttgtcacactcatgaggatgaatggtcctttccgcctacacacagaggggcaagggcttcaagctctttctttccttgactgtgttatcagctttacaaattaacaccatgctagtttgatcctgctagaagtacaggaaggcagaaatggaggattaggagaattactcatcttttggatgaacagtttccaaatcccatttggcacatcactctagactggtaaaggggaggctgacactgaggccacagacccaactggctctaggacatcacgttgttcagtcctttgcttatctaatcatttgtgttcttacccagtgctcactaggtcacccacatagccacttcccctcccagcaaaagttcccagtttaggcacctgtctgggatcatccagtatccaagcttaggggtgaagggagggagcagagaactagtctcaactggttcgttggtatataggtctcttctcaatgttcctaaagtgcatgcagtggcatccccctcaaggcctggctccatgattctgagaggactagaatcaggacagtcagatctgtggtcacatcctgcccaattccagctctgaggtccatcaaaccatctgcttctcccttggcaagaagctccctctgtctgactggcagcagggtcagtggccatccttttctaccttcagctgttgtgcatctcctccacgttttcctggagtaaaggaacaagcaggttcttatccaaatacccaacctgtgaagatgagacggcccttgggaagaggtattagccaagttttcagtatgatgcccggcagaaagaatttgttgtctttgtcttaagcttattatcctcccaggtcataggaagatctaaagtccaatcagtctccttactcagaattcacagctttcccctcaaacttaaaatgcccatgtcatttcacgagtacccataactacccatcgtttagatacatgtcctcccttggnctagaaatctgcagcagttcctacttaaactgatggatgctttgggctttggaggtatctcatccctatgcctgttgccctgaagctgccggaaggaaaggccccactcaactactgggaagaaagcccataattcaaggcttttaatacagtcactacacaagctctccctctgatttaggagatcttgttacctcctcatctacatgtgcttaaaaacaaaaagaaacctataattattcaattcacctgtggtccaaataagtctcacatccagccattcccctgagagggcaggaggccagactttgaactttccacagctgggtcttcattttactagtgagataaagaggtgcagattagggtgacagtccatctaagcaagtggacgatctggggaactgtaggccttgctgaagcatcctcccacagaaaggagataagggccttatccaattggctgtacacaatagatcagtgcttctttcctagacaaggctgaaaggggccaacattatttctgaagacttcattattggaattctatgggagtgatctcactgagctattttggaatagaaatgtggctagttgcctgacctccctcaatggtttcacgtggctttcaaagggaaggaagggcagtgctgacttttggtaaaatgggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccaggtaaggagggaaggatacttatgtgtgtgtgtggagtgtggagatgatagtggtggtggaacttgaaagctagattcagtcctgaggaatggttcctctgttctgagtctacagcatctgcggaatggaatgatcactcttccaaggtgtgcagcagggtgtcaacactttcatatctgaatgtctttgcccttacagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattgaaattttagcagtctggaattcaagcttttgagggaaagaaggattcattttgtatactaaagaaaagctacataatcaatagctacgtaatcaacttcagcaagttcctaagctgtggccctggatcccttcactccatactcttcagggaggtgtcaaaggtggtcaagcttgggaggctgaggcaggagaatcacttgaacctgggaggtggaggttgcagtgagccaagatcatgccactgcaccccagcctgggtgacatagagagactctgtctcaaa

SEQ ID NO: 31323 - DNA, 3651 bp, Homo sapiens
  misc_feature (1714)..(1714): n is a, c, g, or t
ttagggacagcaaaaagtttccaattactgccaactcctagtgatcgacctggaatgtgtttcaaacagctgctcatgtagctataccctctttctcccatttcatcctaagcatttgcctcagaagcataaaatctcttgagagttgtatccagagttaccaagctctcagctatcaaatctgcttcagtctcattttcttcttgtaaattagtcatttgaacccccaaactgacagaataggagactaaagcccaaaaaggggaagggctggcctatgggcagttgcactctgtagaccccaggctactgcttaccagccaagcattctaccttcttacggctgcaactgttaaaggctacttaggcctttctattggatgaaggagcatgcagttacgtgtatattcactgagcaaaatacttgattgtagaatccatgaaatttttttttttttaatttcaagaagaggccttcacagtctctcaagtatgggatggctgtggacaaatactgccaattcagctaactgctgcctggatgttgctttgagtttgatttttgctccatacttaactaaaacaactagcattcacgtagacatgttaaaatactttccccttccccaacagtggttccttccacagacagtgactaatggttttttcttttggggagagggtggcatacaacatagaggcttgaaccaaaggcctctgcaatgttgtcacactcatgaggatgaatggtcctttccgcctacacacagaggggcaagggcttcaagctctttctttccttgactgtgttatcagctttacaaattaacaccatgctagtttgatcctgctagaagtacaggaaggcagaaatggaggattaggagaattactcatcttttggatgaacagtttccaaatcccatttggcacatcactctagactggtaaaggggaggctgacactgaggccacagacccaactggctctaggacatcacgttgttcagtcctttgcttatctaatcatttgtgttcttacccagtgctcactaggtcacccacatagccacttcccctcccagcaaaagttcccagtttaggcacctgtctgggatcatccagtatccaagcttaggggtgaagggagggagcagagaactagtctcaactggttcgttggtatataggtctcttctcaatgttcctaaagtgcatgcagtggcatccccctcaaggcctggctccatgattctgagaggactagaatcaggacagtcagatctgtggtcacatcctgcccaattccagctctgaggtccatcaaaccatctgcttctcccttggcaagaagctccctctgtctgactggcagcagggtcagtggccatccttttctaccttcagctgttgtgcatctcctccacgttttcctggagtaaaggaacaagcaggttcttatccaaatacccaacctgtgaagatgagacggcccttgggaagaggtattagccaagttttcagtatgatgcccggcagaaagaatttgttgtctttgtcttaagcttattatcctcccaggtcataggaagatctaaagtccaatcagtctccttactcagaattcacagctttcccctcaaacttaaaatgcccatgtcatttcacgagtacccataactacccatcgtttagatacatgtcctcccttggnctagaaatctgcagcagttcctacttaaactgatggatgctttgggctttggaggtatctcatccctatgcctgttgccctgaagctgccggaaggaaaggccccactcaactactgggaagaaagcccataattcaaggcttttaatacagtcactacacaagctctccctctgatttaggagatcttgttacctcctcatctacatgtgcttaaaaacaaaaagaaacctataattattcaattcacctgtggtccaaataagtctcacatccagccattcccctgagagggcaggaggccagactttgaactttccacagctgggtcttcattttactagtgagataaagaggtgcagattagggtgacagtccatctaagcaagtggacgatctggggaactgtaggccttgctgaagcatcctcccacagaaaggagataagggccttatccaattggctgtacacaatagatcagtgcttctttcctagacaaggctgaaaggggccaacattatttctgaagacttcattattggaattctatgggagtgatctcactgagctattttggaatagaaatgtggctagttgcctgacctccctcaatggtttcacgtggctttcaaagggaaggaagggcagtgctgacttttggtaaaatgggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccaggtaaggagggaaggatacttatgtgtgtgtgtggagtgtggagatgatagtggtggtggaacttgaaagctagattcagtcctgaggaatggttcctctgttctgagtctacagcatctgcggaatggaatgatcactcttccaaggtgtgcagcagggtgtcaacactttcatatctgaatgtctttgcccttacagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattgaaattttagcagtctggaattcaagcttttgagggaaagaaggattcattttgtatactaaagaaaaaaacagcattgcccaataatgtgttaacttctcaatctggaaagtgtagtgagagctacataatcaatagctacgtaatcaacttcagcaagttcctaagctgtggccctggatcccttcactccatactcttcagggaggtgtcaaaggtggtcaagcttgggaggctgaggcaggagaatcacttgaacctgggaggtggaggttgcagtgagccaagatcatgccactgcaccccagcctgggtgacatagagagactctgtctcaaa

SEQ ID NO: 31324 - DNA, 3715 bp, Homo sapiens
  misc_feature (1714)..(1714): n is a, c, g, or t
ttagggacagcaaaaagtttccaattactgccaactcctagtgatcgacctggaatgtgtttcaaacagctgctcatgtagctataccctctttctcccatttcatcctaagcatttgcctcagaagcataaaatctcttgagagttgtatccagagttaccaagctctcagctatcaaatctgcttcagtctcattttcttcttgtaaattagtcatttgaacccccaaactgacagaataggagactaaagcccaaaaaggggaagggctggcctatgggcagttgcactctgtagaccccaggctactgcttaccagccaagcattctaccttcttacggctgcaactgttaaaggctacttaggcctttctattggatgaaggagcatgcagttacgtgtatattcactgagcaaaatacttgattgtagaatccatgaaatttttttttttttaatttcaagaagaggccttcacagtctctcaagtatgggatggctgtggacaaatactgccaattcagctaactgctgcctggatgttgctttgagtttgatttttgctccatacttaactaaaacaactagcattcacgtagacatgttaaaatactttccccttccccaacagtggttccttccacagacagtgactaatggttttttcttttggggagagggtggcatacaacatagaggcttgaaccaaaggcctctgcaatgttgtcacactcatgaggatgaatggtcctttccgcctacacacagaggggcaagggcttcaagctctttctttccttgactgtgttatcagctttacaaattaacaccatgctagtttgatcctgctagaagtacaggaaggcagaaatggaggattaggagaattactcatcttttggatgaacagtttccaaatcccatttggcacatcactctagactggtaaaggggaggctgacactgaggccacagacccaactggctctaggacatcacgttgttcagtcctttgcttatctaatcatttgtgttcttacccagtgctcactaggtcacccacatagccacttcccctcccagcaaaagttcccagtttaggcacctgtctgggatcatccagtatccaagcttaggggtgaagggagggagcagagaactagtctcaactggttcgttggtatataggtctcttctcaatgttcctaaagtgcatgcagtggcatccccctcaaggcctggctccatgattctgagaggactagaatcaggacagtcagatctgtggtcacatcctgcccaattccagctctgaggtccatcaaaccatctgcttctcccttggcaagaagctccctctgtctgactggcagcagggtcagtggccatccttttctaccttcagctgttgtgcatctcctccacgttttcctggagtaaaggaacaagcaggttcttatccaaatacccaacctgtgaagatgagacggcccttgggaagaggtattagccaagttttcagtatgatgcccggcagaaagaatttgttgtctttgtcttaagcttattatcctcccaggtcataggaagatctaaagtccaatcagtctccttactcagaattcacagctttcccctcaaacttaaaatgcccatgtcatttcacgagtacccataactacccatcgtttagatacatgtcctcccttggnctagaaatctgcagcagttcctacttaaactgatggatgctttgggctttggaggtatctcatccctatgcctgttgccctgaagctgccggaaggaaaggccccactcaactactgggaagaaagcccataattcaaggcttttaatacagtcactacacaagctctccctctgatttaggagatcttgttacctcctcatctacatgtgcttaaaaacaaaaagaaacctataattattcaattcacctgtggtccaaataagtctcacatccagccattcccctgagagggcaggaggccagactttgaactttccacagctgggtcttcattttactagtgagataaagaggtgcagattagggtgacagtccatctaagcaagtggacgatctggggaactgtaggccttgctgaagcatcctcccacagaaaggagataagggccttatccaattggctgtacacaatagatcagtgcttctttcctagacaaggctgaaaggggccaacattatttctgaagacttcattattggaattctatgggagtgatctcactgagctattttggaatagaaatgtggctagttgcctgacctccctcaatggtttcacgtggctttcaaagggaaggaagggcagtgctgacttttggtaaaatgggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccaggtaaggagggaaggatacttatgtgtgtgtgtggagtgtggagatgatagtggtggtggaacttgaaagctagattcagtcctgaggaatggttcctctgttctgagtctacagcatctgcggaatggaatgatcactcttccaaggtgtgcagcagggtgtcaacactttcatatctgaatgtctttgcccttacagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattgaaattttagcagtctggaattcaagcttttgagggaaagaaggattcattttgtatactaaagaaaaaaacagcattgcccaataatgtgttaacttctcaatctggaaagtgtagtgagagctacataatcaatagctacgtaatcaacttcagcaagttcctaagctgtggccctggatcccttcactccatactcttcagggaggtgtcaaaggtggtcaagcttgggaggctgaggcaggagaatcacttgaacctgggaggtggaggttgcagtgagccaagatcatgccactgcaccctggttcctggttcagcggtctgctgctcagccaatataaatacactctgacttggtatcactcgcttgcttccgagtgtgaattcaagtggagcacaa

SEQ ID NO: 31325 - DNA, 3398 bp, Homo sapiens
  misc_feature (1714)..(1714): n is a, c, g, or t
ttagggacagcaaaaagtttccaattactgccaactcctagtgatcgacctggaatgtgtttcaaacagctgctcatgtagctataccctctttctcccatttcatcctaagcatttgcctcagaagcataaaatctcttgagagttgtatccagagttaccaagctctcagctatcaaatctgcttcagtctcattttcttcttgtaaattagtcatttgaacccccaaactgacagaataggagactaaagcccaaaaaggggaagggctggcctatgggcagttgcactctgtagaccccaggctactgcttaccagccaagcattctaccttcttacggctgcaactgttaaaggctacttaggcctttctattggatgaaggagcatgcagttacgtgtatattcactgagcaaaatacttgattgtagaatccatgaaatttttttttttttaatttcaagaagaggccttcacagtctctcaagtatgggatggctgtggacaaatactgccaattcagctaactgctgcctggatgttgctttgagtttgatttttgctccatacttaactaaaacaactagcattcacgtagacatgttaaaatactttccccttccccaacagtggttccttccacagacagtgactaatggttttttcttttggggagagggtggcatacaacatagaggcttgaaccaaaggcctctgcaatgttgtcacactcatgaggatgaatggtcctttccgcctacacacagaggggcaagggcttcaagctctttctttccttgactgtgttatcagctttacaaattaacaccatgctagtttgatcctgctagaagtacaggaaggcagaaatggaggattaggagaattactcatcttttggatgaacagtttccaaatcccatttggcacatcactctagactggtaaaggggaggctgacactgaggccacagacccaactggctctaggacatcacgttgttcagtcctttgcttatctaatcatttgtgttcttacccagtgctcactaggtcacccacatagccacttcccctcccagcaaaagttcccagtttaggcacctgtctgggatcatccagtatccaagcttaggggtgaagggagggagcagagaactagtctcaactggttcgttggtatataggtctcttctcaatgttcctaaagtgcatgcagtggcatccccctcaaggcctggctccatgattctgagaggactagaatcaggacagtcagatctgtggtcacatcctgcccaattccagctctgaggtccatcaaaccatctgcttctcccttggcaagaagctccctctgtctgactggcagcagggtcagtggccatccttttctaccttcagctgttgtgcatctcctccacgttttcctggagtaaaggaacaagcaggttcttatccaaatacccaacctgtgaagatgagacggcccttgggaagaggtattagccaagttttcagtatgatgcccggcagaaagaatttgttgtctttgtcttaagcttattatcctcccaggtcataggaagatctaaagtccaatcagtctccttactcagaattcacagctttcccctcaaacttaaaatgcccatgtcatttcacgagtacccataactacccatcgtttagatacatgtcctcccttggnctagaaatctgcagcagttcctacttaaactgatggatgctttgggctttggaggtatctcatccctatgcctgttgccctgaagctgccggaaggaaaggccccactcaactactgggaagaaagcccataattcaaggcttttaatacagtcactacacaagctctccctctgatttaggagatcttgttacctcctcatctacatgtgcttaaaaacaaaaagaaacctataattattcaattcacctgtggtccaaataagtctcacatccagccattcccctgagagggcaggaggccagactttgaactttccacagctgggtcttcattttactagtgagataaagaggtgcagattagggtgacagtccatctaagcaagtggacgatctggggaactgtaggccttgctgaagcatcctcccacagaaaggagataagggccttatccaattggctgtacacaatagatcagtgcttctttcctagacaaggctgaaaggggccaacattatttctgaagacttcattattggaattctatgggagtgatctcactgagctattttggaatagaaatgtggctagttgcctgacctccctcaatggtttcacgtggctttcaaagggaaggaagggcagtgctgacttttggtaaaatgggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccagatagatggctccccaataccagaagtgagttcggcaaagagaaggccacggagaatgaccccattttggagaggggtttccctcaggcctattggagcctcctgccgggatgattctgagtgtatcacaaggctatgcagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattgaaattttagcagtctggaattcaagcttttgagggaaagaaggattcattttgtatactaaagaaaaaaacagcattgcccaataatgtgttaacttctcaatctggaaagtgtagtgagagctacataatcaatagctacgtaatcaacttcagcaagttcctaagctgtggccctggatcccttcactccatactcttcagggaggtgtcaaaggtggtcaagcttgggaggctgaggcaggagaatcacttgaacctgggaggtggaggttgcagtgagccaagatcatgccactgcaccccagcctgggtgacatagagagactctgtctcaaa

SEQ ID NO: 31326 - DNA, 3115 bp, Homo sapiens
  misc_feature (1714)..(1714): n is a, c, g, or t
ttagggacagcaaaaagtttccaattactgccaactcctagtgatcgacctggaatgtgtttcaaacagctgctcatgtagctataccctctttctcccatttcatcctaagcatttgcctcagaagcataaaatctcttgagagttgtatccagagttaccaagctctcagctatcaaatctgcttcagtctcattttcttcttgtaaattagtcatttgaacccccaaactgacagaataggagactaaagcccaaaaaggggaagggctggcctatgggcagttgcactctgtagaccccaggctactgcttaccagccaagcattctaccttcttacggctgcaactgttaaaggctacttaggcctttctattggatgaaggagcatgcagttacgtgtatattcactgagcaaaatacttgattgtagaatccatgaaatttttttttttttaatttcaagaagaggccttcacagtctctcaagtatgggatggctgtggacaaatactgccaattcagctaactgctgcctggatgttgctttgagtttgatttttgctccatacttaactaaaacaactagcattcacgtagacatgttaaaatactttccccttccccaacagtggttccttccacagacagtgactaatggttttttcttttggggagagggtggcatacaacatagaggcttgaaccaaaggcctctgcaatgttgtcacactcatgaggatgaatggtcctttccgcctacacacagaggggcaagggcttcaagctctttctttccttgactgtgttatcagctttacaaattaacaccatgctagtttgatcctgctagaagtacaggaaggcagaaatggaggattaggagaattactcatcttttggatgaacagtttccaaatcccatttggcacatcactctagactggtaaaggggaggctgacactgaggccacagacccaactggctctaggacatcacgttgttcagtcctttgcttatctaatcatttgtgttcttacccagtgctcactaggtcacccacatagccacttcccctcccagcaaaagttcccagtttaggcacctgtctgggatcatccagtatccaagcttaggggtgaagggagggagcagagaactagtctcaactggttcgttggtatataggtctcttctcaatgttcctaaagtgcatgcagtggcatccccctcaaggcctggctccatgattctgagaggactagaatcaggacagtcagatctgtggtcacatcctgcccaattccagctctgaggtccatcaaaccatctgcttctcccttggcaagaagctccctctgtctgactggcagcagggtcagtggccatccttttctaccttcagctgttgtgcatctcctccacgttttcctggagtaaaggaacaagcaggttcttatccaaatacccaacctgtgaagatgagacggcccttgggaagaggtattagccaagttttcagtatgatgcccggcagaaagaatttgttgtctttgtcttaagcttattatcctcccaggtcataggaagatctaaagtccaatcagtctccttactcagaattcacagctttcccctcaaacttaaaatgcccatgtcatttcacgagtacccataactacccatcgtttagatacatgtcctcccttggnctagaaatctgcagcagttcctacttaaactgatggatgctttgggctttggaggtatctcatccctatgcctgttgccctgaagctgccggaaggaaaggccccactcaactactgggaagaaagcccataattcaaggcttttaatacagtcactacacaagctctccctctgatttaggagatcttgttacctcctcatctacatgtgcttaaaaacaaaaagaaacctataattattcaattcacctgtggtccaaataagtctcacatccagccattcccctgagagggcaggaggccagactttgaactttccacagctgggtcttcattttactagtgagataaagaggtgcagattagggtgacagtccatctaagcaagtggacgatctggggaactgtaggccttgctgaagcatcctcccacagaaaggagataagggccttatccaattggctgtacacaatagatcagtgcttctttcctagacaaggctgaaaggggccaacattatttctgaagacttcattattggaattctatgggagtgatctcactgagctattttggaatagaaatgtggctagttgcctgacctccctcaatggtttcacgtggctttcaaagggaaggaagggcagtgctgacttttggtaaaatgggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattg

SEQ ID NO: 31327 - DNA, 222 bp, Homo sapiens
ctttctgtggtcttttctttcttttaaacccttggttatagatagaacgttgtcctttacacttaagctctacatgataagagcaaacttaaggcacttttgtttcctccaaaatttccgggctcttcatgaagagatttttctcgaatggtcaagatttagatgaaacttaggaacacacagttctctgctaagaagccatcagatcagccggaaaaaaaa

SEQ ID NO: 31328 - DNA, 354 bp, Homo sapiens
aatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgaga

SEQ ID NO: 31329 - DNA, 350 bp, Homo sapiens
ttttcatatcattaaataatttgtaaaaatatgactttttcataaatgcataatttatcccatagatgtattgtgatttattttcctgttaagacattttgttaatgtctaaatgttttacttttataaataatgttgcattgaacagccctatacatagatatttgtaataattcaactactattttttgaacactagttactgctctgaatgttggagatacattagtgaacaaacagtccaaagtccctgccctcatggggaggaggaaagagagacaataaggatgtaaactataaattacatcaaatagtgatgagtgctctggagaaaactaaatcagggatgg

SEQ ID NO: 31330 - DNA, 406 bp, Homo sapiens
aaatttgttagtatcgtgataaatggacataccatttctgcttctggaaagtcgctaatgactaatagccacaaaggaagcattatgctttgttttctaagagctttactagactacttatttaatgcaaatgctattcccctgagataggccagcagctctcaaacttgcggcacatcggaatgacatcacaagcttgtaaacatggaactgcccagggccccattccagaccaaccgagttagaatctccaggggtggggcccaggcatctgatgtttattacactccccgggtgattctcacacacacataagtttgagaatcattgaggtctgtgagtggtagggttttgttattgttttaggaattacaatgttcaggtttgtcagtttagtcagggcctc

SEQ ID NO: 31331 - DNA, 615 bp, Homo sapiens
ggatgccacattgcccttcacagatgctttgccacctgattctaagatgtgacatccaagatctccagccagaaaaggagttgctgccacatcttgtatgaactagcaatcaagtggctatttcgtccagcccattagccctccacccacccccttggtctttcacttggcattactttcagtatcttgaggattattgtagtactgtgtaacacatggcctttcagtaagaaaagcgttgatggcattgcctggcagaaggaagtagagagcagaggcttaggggctgtgtgccagatggcattttgggagaaggagaacatctcacttctttgaaggcttgagatctcaggtccaaaggagactgagtgtgtgggaggagtggtagctactgaccaggaagttgttgctggctgcacttccctcctgatagggaatcctggattgcctacagaggggtctgaggcaattgtatctggtttggggttctaccaagtgaagctggagatttgtaaaagcttgtcatctattgatcgttggtccttgtactataccaatgtggagatggagacatagtgcaatttgcttagatttaggtgccaaaaaaaaaaaaaa

SEQ ID NO: 31332 - DNA, 293 bp, Homo sapiens
ttttttttagctgagtcctgaaagatttgtacggattgagaaaaacagaagggatcgttaaacaaaagaacaaacccaagcagtggtacatccagacactatgactcctatctcctggttaggaacagaggcaccttacagtgggagatcagattggaatgatgggttaaggcaggacagtatagcactccagtgcaggctaagaggttgaacatggtgtccaaggcacagagcgtcatttccccagctcctccccacaattgtgagctctagaaatcccttaccccataaac

SEQ ID NO: 31333 - DNA, 939 bp, Homo sapiens
atgccaagtgcaatagaggcaatatatattattttaattgctggtgaattgaccatagggatttggggaaatggattcattgtactagttaactgcattgactggctcaaaagaagagatatttccttgattgacatcatcctgatcagcttggccatctccagaatctgtctgctgtgtgtaatatcattagatggcttctttatgctgctctttccaggtacatatggcaatagcgtgctagtaagcattgtgaatgttgtctggacatttgccaataattcaagtctctggtttacttcttgcctcagtatcttctatttactcaagatagccaatatatcgcacccatttttcttctggctgaagctaaagatcaacaaggtcatgcttgcgattcttctggggtcctttcttatctctttaattattagtgttccaaagaatgatgatatgtggtatcaccttttcaaagtcagtcatgaagaaaacattacttggaaattcaaagtgagtaaaattccaggtactttcaaacagttaaccctgaacctgggggtgatggttccctttatcctttgcctgatctcatttttcttgttacttttctccctagttagacacaccaagcagattcgactgcatgctacagggttcagagaccccagtacagaggcccacatgagggccataaaggcagtgatcatctttctgctcctcctcatcgtgtactacccagtctttcttgttatgacctctagcgctctgattcctcagggaaaattagtgttgatgattggtgacatagtaactgtcattttcccatcaagccattcattcattctaattatgggaaatagcaagttgagggaagcttttctgaagatgttaagatttgtgaagtgtttccttagaagaagaaagccttttgttccatag

SEQ ID NO: 31334 - DNA, 386 bp, Homo sapiens
tttccaaaagaaaatagaggagttatggagaccaatatttaatagaataatgcctgattattttgcttttgaggtctagtaactgctagtaaacttgcctaattaattcacatttagaagtagagtaaagagggtttcaaccacttgaaacaccactgacttcatttcatgtgagagttgctatggagagctaatgaactatgaggctgcaggtctctcagccaataggtcttctagatttcctatgtgactcccttttctggtcataggcgattttgcttttgctttgagtgttatagcacaataaggtgtcagacactctactcttaccaagtcttacacaaagtttatcttgttatttggtggagcttggctcataaaaacaa

SEQ ID NO: 31335 - DNA, 1422 bp, Homo sapiens
acgctatgacccgcttgacgctatgacagcgggaaacggggggcgcgcccgtacatagggaggctttaaaaccttgaggtgattcatcttccaggctctccttccatcaagtctctcctccctagcgctctgggtccttaatggcagcagccgccgctaccaagatccttctgtgcctcccgcttctgctcctgctgtccggctggtcccgggctgggcgagccgaccctcactctctttgctatgacatcaccgtcatccctaagttcagacctggaccacggtggtgtgcggttcaaggccaggtggatgaaaagacttttcttcactatgactgtggcaacaagacagtcacacctgtcagtcccctggggaagaaactaaatgtcacaacggcctggaaagcacagaacccagtactgagagaggtggtggacatacttacagagcaactgcgtgacattcagctggagaattacacacccaaggaacccctcaccctgcaggccaggatgtcttgtgagcagaaagctgaaggacacagcagtggatcttggcagttcagtttcgatgggcagatcttcctcctctttgactcagagaagagaatgtggacaacggttcatcctggagccagaaagatgaaagaaaagtgggagaatgacaaggttgtggccatgtccttccattacttctcaatgggagactgtataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctgaggagagtcctttagagtgacaggttaaagctgataccaaaaggctcctgtgagcacggtcttgatcaaactcgcccttctgtctggccagctgcccacgacctacggtgtatgtccagtggcctccagcagatcatgatgacatcatggacccaatagctcattcactgccttgattccttttgccaacaattttaccagcagttatacctaacatattatgcaattttctcttggtgctacctgatggaattcctgcacttaaagttctggctgactaaacaagatatatcattttctttcttctctttttgtttggaaaatcaagtacttctttgaatgatgatctctttcttgcaaatgatattgtcagtaaaataatcacgttagacttcagacctctggggattctttccgtgtcctgaaagagaatttttaaattatttaataagaaaaaatttatattaatgattgtttcctttagtaatttattgttctgtactgatatttaaataaagagttctatttcccaaaaaaaaaaa

SEQ ID NO: 31336 - DNA, 413 bp, Homo sapiens
ctgtggaacttttccctgaaagtaatcctcttgcatttttatttgcttggttttctatttgtcactaattcaaccccaatcatatctgaagatcatgacatcatttatcagttattattcttgacccaccccaatctggactggtttctccccgtgcttggtgtgtcactgtcaccctgggcactccccacactgctcctctgttggatctctgttttctgtgtaacctcttcttttatcaccttaaaaatacaaaaaaattagctgggcgtggtggcgggcacctgtggtcccagctactcgggaggctgaggcaggagaatggcatgaacccgggaggtggagcctgcagtgagccgagattgcaccactgcactccagcctgggtgacagagtgagactccgtctcaaaa

SEQ ID NO: 31337 - DNA, 339 bp, Homo sapiens
ctgtggaacttttccctgaaagtaatcctcttgcatttttatttgcttggttttctatttgtcactaattcaaccccaatcatatctgaagatcatgacatcatttatcagttattattcttgacccaccccaatctggactggtttctccccgtgcttggtgtgtcactgtcaccctgggcactccccacactgctcctctgttggatctctgttttctgtgtaacctcttcttttatcaccttattttgggggagtatctgcatgtctaaaaatgtgctcacacttgatttgattgggtatgaaattctatgttggaattagtgccgggcgcagtgg

SEQ ID NO: 31338 - DNA, 361 bp, Homo sapiens
ccagagagcttaagtgacttcctcgaggtcatagttacttactgccttagtcccaatttgaattcaattctgattccaaataagttgcgcttaaataagacaacagatgtgggaaaaatatgtgaatgtgtagtgttgctatgtgtactgtctttacaagtagctaattattttagcacaaagatgtgcaaagaaaggagactttatggagagttcaggagaaaaaggattttgtggtggccatcactttcattcaatttgcgactgctctgatggcacattagatgaagttactgttgatcctgagttacgtgaataagaaaaacaattgaactgcttattaaaaaagtaaacatgtctt

SEQ ID NO: 31339 - DNA, 469 bp, Homo sapiens
gattttctctggtgctatgatttagtttcttgctttttattttttgtgtatccattatatgatttttgatttgaggttaccatgagcttgcaagtagtatcttataacctattgttttaagctgataacaacttgacactgcttgcatgaactacctaacaagcaaaaagaaaactaataaaaactctacacttcaaattcatcccctgctatttaattttttgttatttctgtgtatatcttatactatctatatgtttgaaagttgttgtagttattttttattggttttctgtgaccttactattactagtgaggtttttgttttgttttgttttgttttgagacagagttttactctgttgcccaggttggagtgcagtgacgtgatctcggctcactgcaacttccacctcttgggttcaagaaattctcctgtctcagcctcccgagtagctgggactacagg

SEQ ID NO: 31340 - DNA, 2210 bp, Homo sapiens
tcttggccctcctataaagaagcagcctctccttcctctgatgtgcagggtgtaggactagtggtagggctgccacggaagtgtcctctgaggctctgcaggtagcggggaaagccagtagggagtctgctgtcttcttcaagatggagccggccattacagaaagatgttgacatttgctaggggctatgcagtctgtggctgatgcagggagttttcagaaagttctggagggttctgctgtcactggactggggttggtgctgagctctgggcctggctttgggagatgtcaccctgggatagggaggaggaagctgcatttctaatggcttcctcctccagagaggcacgtatatgcaggctgacatccgagggcctgtgtcgcctcagacagccctgacagtggccacagtcccgtacccattgtgaggggctggggcatgcctaggagggctaggtgctgaacatctatgtgcctataaactcgtcttcgttccaaacagctactgctgtctgccctgggcacgtcacgttgcatcctaggccttagcttctccactgtttgctacctcagattatgccctctgggaacccagccgtatccctcccctaggacagtggtgacctggtccttccaccacactcagtctttggagagcgagctgtccagccacagaaatgagggtgtggtgcgtggcttcctgctccccacagcccagccccctgttggggctccaaagccgaagacagggcctcttcagactccttgggagtaggtttcaggaggcaccaagaatcaatgactgacccagggggcctggcagccactagtatgaactgctggagacctgtctgtcttatagacatgtcaggaaaatagaaacaggcattttctctagctccaagtggggagatattttggggtcacagcttctttggctaagcagggtgtttcttgaaggttcagatgccccactgtgtacatgggatattctgcttctgagtgtaggtgatgaatccaggtcctcagtggagaattttctggagctaagatcaaagcatgtgtcttcctgggagagaagagttccgttcttttatgtgggtttccctaatagtcagaatccacaaaccagccagccagccagccaagcctctgcgatgatgttctcatccggtctaacgctgggctggaaaccttggacagagttcatgcgggggcagagggggtgccagtctctgaggcagggctgcagtcacccctgaagaactaagtgaacaggaacccctctgtgccagtgaccactgtggggctaaagggacaaaaaggaccagggtaccaggcagaagcagatccttgatagctgacgacagcactgcgccctgtgcttggtgcactccctccttcaggaggagagggtggcatggggtctgtgcgggatggcagggggattgggtgggtgggaagagaggtgccatcggtaggaggctggcctccagtagaggagagcagcttttgccatcagtcactttacaaaccatttcaaggaaggacaacctctctggctcctgacacaagccaggcctcggtgcttttatctgttgtggtggtttttcttctttccctttttaaaagacgcatgaccaagacaacctagggagtttgtcttgcttgcctttgactatttccttaatccaaccatgctctcgagggctgagcagagactagactcaaggcacaggtttctggtgatggagtaaagttacagcggtatctcatgtctacacaagaagaggaacgttctgaaagctccaacaacttcttgagggggatggaccaatacagctttgggctcaggattccctagcctcctctgcccatcgcgtgcactgattggaggagtctggcccaaacactctcatatgaacctcgacatgctggagtggggtctggcaggagctgatgacagtttgagggacttgagtgtccctagcctggcagttggctcccggaagcactagacactgacactcattggtagaccctccctccccgccgttgtgtttggttcttttgcactccatgtactgcagaaggatggaaggacctgggtgctggctgggctgtgtatactgtgtatacaagggagctggctgctgaggtgaccacagccttctcctaataaagctgtaagtatttaaaacctgtg

SEQ ID NO: 31341 - DNA, 281 bp, Homo sapiens
gtgctcgaataattactattccgaatattaggatcctactatttccttatcaatgtttttatttccacatagaagtctgttaaccgaacatactttgtagctcaataatcggtaaattctgattagcacctgattttgtttcagttagcccattctgtttacatgagtagatatatcaattatgcttaagtttagaagacatccatagaaattctcaggtttattctttctctctagttgttcttgcttaataactgcctttttcacagattttcccgtta

SEQ ID NO: 31342 - DNA, 451 bp, Homo sapiens
gctagttaaagaaattttttcttcaatattttcttaattattttttattgaattaactcgagggtaacaactttcttcctaagaataaataaataaaccctattggagctattcccagagttggcaaaatttgagattattataagaaaataaaagaaattggaggctgggcacagtggctcacacctgtaatcccagcactttgggaagccgaggtgggtggatcacaaggtcaggagttcaagaccagcctggccaacatagtgaaaccccatctctactaaaaatacaaaaacaattagctgggtgtggtagcgggcgcctgtagtcccagctacttgggaggctgaggcaggagaattggttgaacctgggaggcggaggttgcagtgagccaagattgtgccactgcaatgcagcctgggtgacatagcgagactctgtctcaaaa

SEQ ID NO: 31343 - DNA, 403 bp, Homo sapiens
tatatcagcttacgttgacttaatagattcagattgcacgtctgtaataattgttgcatatagactagacttttgaaatcgattaatataatcagggacaagttaaaaccaggagttggtaacccattaattatagtttgaaactttgcctgctagaatccccacttgccacctccttacccaggggagggtgaaggaagggatagaggaaggcctggcatggtggctcatacctataatcctagtactttgggaggctgaggcagaaggatcacttgagcctaggagtttgagaccagcctgggcaacatggtgaaacctacaaaagattcaaaaatttaacagggcatggttggcacgtgcctgtggtcccagctacgtgggaggctgaggtgggaggctg

SEQ ID NO: 31344 - DNA, 485 bp, Homo sapiens
cgcggccgcaccccccacccaccccggcgcgggggcccggccgcgggaacgccctcccggaatgaagcgcttcccggtgccttcaagtttctcagcatcccctggactggggactggagggccacccacacaaggcatttcttaccattccgacacaaaagcattccagtttgtgttgtagcagagacacagatgaggggatctccttcatccttctccagaagagaagaggaaacagaagaagaaacgcctggtgcagagtcccgattcctacttcatggatatgacatgcccaggatgctataaaatcaccatggtctgtagccatgcacaaacggtagttttgtgtgttgcctgctccactgttctctgccagcctacaggaggaaaaggaaggctacagaaggatgttccttcaggaggaagcagcacccaaagcactctgaatcaagatgagtgggaaaccatctcaataaacacatttt

SEQ ID NO: 31345 - DNA, 506 bp, Homo sapiens
gactagattgcctaaagcttccctagccgaaagaaactacctgccacgtcaataacatgcaactgtgggtgactcagggacatataacctaaagctactgggtaaaatattttaagaatgagacttgggaagctgaacagcatactgatttgccgtcttcttccgccattgtattgaccaggcaagtccacgcctgagttcagagttgcagtgggcaggagagatgtgtgtccaggaagaaattgtggcttctgctctgaagatctggtcacatctcgggtcaattgcagtttgaagaacctaggaaagactgtatttggttctaatcttggtgatatttgggcctcttctaagaggtattcagtgtctctcttgagaaggcttaggccttcctggcagccctgactgccttcatttctcttggaacttccaggtccaggcctgctctgaatcctcctttctggtcctggatacagagagtgtatgtcttaacaccaaaaaaaaga

SEQ ID NO: 31346 - DNA, 130 bp, Homo sapiens
gatcacactcctcattgttgaggaatccctctttctatgtgaccataggatttccagagcctactaacagcatgatctctcctcactgtttctgctacacttggtcattaaaacatcaccaaactaccga

SEQ ID NO: 31347 - DNA, 332 bp, Homo sapiens
tgataatgtaagtacattacatgaatcgtattgtcttcctcttctatagtcacatagcactcaaaattattaccactcaaatacagggtattttattgattatgaactgcttatgaacaagaggcatatcctattcatcactgtattctagcattaggcacagaataaatatttataaagttgagtttttaaaatattaggagctggatgagtgggatggctcaggcctgtaatcccagaacttttgagaggccaaggcatgaggatgacttgagcccaggagttagagaccagactgggcaacataatgagaccccatctctacaaaaaaa

SEQ ID NO: 31348 - DNA, 424 bp, Homo sapiens
ttgagacaaggtacaaatacagctcacctcaacctcaacttgctgggctcaggtgatcctcctgcctagcctcccaaataggtgggaccacaggggcataatttttttaatttttttttttgacacaggatctcaccatgttgtccaggctggtctcacactcctaagctcaagtgatcctcctgcctcagcctccaaaagggtaggattgtagtcacgagccaccacactcaccccagagattttcttaaatgacttgaaacaatgagtcccctaggcttcagtaagaagttctggaagaggggagggcatctacaatgctcagtcaggtcattgagaattctgcctatgccttcacttcctgcttacacagaaacttcaggttagtcacagatgagaactcagaacctcctcggatctttct

SEQ ID NO: 31349 - DNA, 670 bp, Homo sapiens
  misc_feature (4)..(5): n is a, c, g, or t
  misc_feature (87)..(87): n is a, c, g, or t
  misc_feature (279)..(279): n is a, c, g, or t
  misc_feature (665)..(665): n is a, c, g, or t
gctnntcccgccatttcctggggcttggaggaggggttaaaggagcggactgtaggcgtcacatttcctgcgcgcttttcagtctcngtgtccgctggaggtgggggcaggggtaacgtagatatataaagatcggtttcctattctctcacttgctcttggttcacttcttgggaagtcatgtctggacgtggtaagggcgggaagggtttgggtaaggggggtgccaagcgccaccgcaaggtgttgcgtgacaacatccagggcatcaccaagccngccatccggcgtctggcccggcgtggcggtgtgaagcggatctctggtctgatctacgaggagactcgcggggtgctcaaggtgtttttggagaacgtgatccgtgacgctgtcacctatacggagcacgccaagcgcaagacagtcactgccatggacgtggtctacgcgcttaagcgccagggacgcaccctttatggctttggcggttaaggttgctgatttctccacagcttgcatttctgaaccaaaggcccttttcagggccgcccaactaaacaaaagaagagctgtatccattaagtcaagaagctcaatgtgtaattaagatgaatgatactgagctgacatcctaaaaaggaaaattaggggaactccaagtttgncctcc

SEQ ID NO: 31350 - DNA, 392 bp, Homo sapiens
aatagaaaaggggggtgaagtgccaaaggaactccaacactcttctcttagggagaggaggagaaaactataaaagatagacagaacagctagggaggagggaggaaaacaatgggaggatgatgtcttgaaggtcaagagagaaaaaacacaggaataaggagctgtgttcaatgctgccaccataaggagcagtttcagtggaatcagggagagaagtcacgctggagtggattataaaatgaaaaagagctcaaaaaaatggagacatgaccaggtgtgatggctcacacctgtagttccaacatttttggaggttgaagttgaagtatcagttgagtcccagagttcaagtccaccttgggcaacatatggagaccctgtctttatgg

SEQ ID NO: 31351 - DNA, 613 bp, Homo sapiens
gcttttctttgtttgtattaaatattgaaccttcattgatatggttaccatggctacactacctcccaaacttagtggcataaaacattcattcattatgctcacagattctgtgggttagcgatttgactagaacacagtgggggaaggccaatctgtgctctgtgatgtctggggcctcagttggaagacttagaagtctgaggctggaattgtctgaagtttgctcactcataggtctggcagttgctgctggctgtcagctgagaccttattagcagaaacacctacatgtggctttctttgtgggctgggctttatccctgcatggtggctgggttccagggcgggtgtctcaagagaaagtgagccaagagaaagttgtattttctttttaatgacctagccttgtaataagattggacattaccgtgtttacccttgttccacattgattttcctgggatatttgtttttatcacaaccactcctgagaaacaatcttgacaaagatataatgtcattgataggaatggagcaatatacagttggtcctctgtatgtgcaggttctgtatccacagattcaaccaatttctgattgaaaatattaa

SEQ ID NO: 31352 - DNA, 372 bp, Homo sapiens
acctgacaccattttcacaccctccacataggaccagtgcttgccgttattctttgtactcctttcctggactgctcgtcgtgttcaccaagatcaatgctgcccttcttaatactgacataaggtcaggagctgacttgaatcttcacagccctcaactcaacatcctctcctcctgttctaagtctggcaaacattgttgaaaatcatcctgtgactatgttaatatttcacttttatctactgtcaactggtcctgtcccatgtagctgctctcctactaagtgtgatttccatgacgaaagggactgtatcttctctgctcctgtgtctagcacaatgtcttaacatggtacattttcatcagacttt

SEQ ID NO: 31353 - DNA, 224 bp, Homo sapiens
tgcatctctatcaaaactcttaagacaccagtttttactaattagcacacaggatatagttgtgatttgttaggtcttacttgccctgcctatgtatgtatttccgttggcaatccttgatcttatcgtatcttatcattttttaaatgaagaaaatgaggccaaaagaagtgcagtgatttctataatgccactttttttggtaactccataactgatagaat

SEQ ID NO: 31354 - DNA, 254 bp, Homo sapiens
tttttgccacagcttataacaaaaaatagcagtcatgccctgtcctcttcctttcctacttcttattctccagaggctatcactggcaactctttcagttttgatatttacctctatatttataagtaattttttccctagttgttttagatggaatcagttggcctagtacaggaaggagatagggactatcttactgtctcactattgatctcactattgagcatgttcactatgtacactttgattatacc

SEQ ID NO: 31355 - DNA, 432 bp, Homo sapiens
aacatctgaactaaatactgcattaaaaaggagaggcacaaaaattacataaccagttttaacattatattcttcttgggctaggaattaagtcatcgccaccacctgacgcgtgtaaccaatctgctgagagcagaacaagcgcccctcctcaccaccccccagaactggtccgaaacaggattgaaccgcttctaacaaagggtggaaacttagaaaaacaagcctagagtctcctatatttccacaatgtaaccatttaaacaatagattggaaatctcaggactccttctccttttgacaaccctttatctctctcttctaaccaaaaatcaaatccagtgtgccctatacttttcaattccatttgactggcatgggtttcattgaatgcacgttccaaagttagacatgatgctcggaaaagaaaa

SEQ ID NO: 31356 - DNA, 581 bp, Homo sapiens
ccaccagccactcgagttgctgttctgttgatacttgcttagcaaacctagacaaagtgtgccctttatccagaagtgagcagaagctcctggactgagtctaattgtcctggctggcggacttcgtatacatatcattgcatcacttgtgcttcaggagataaaaagctctgattgctcaggcctgagatggggagtggacttagcttcatccaaaccacattgctgagagacagggaggggttgttcccaaaggaaaattagaaggatgttacggaagaatggggaatgactgctggctaggcagaaaccaccgatgtccactacaatgaagttagagaaaaaaaatagataccttagcacagtagctgctttcctcctttcttgcttctgctgtctctgtccctatgcaaagatatttttgtggttataatcatagtatgtatacattgagaaattcatttttcacttgatattattggaaacactcttcgaagttgctatatagtcttcatgatcatatattcatcatcaccccgtccattagaggagatttcccgttttttccccccatgtggggc

SEQ ID NO: 31357 - DNA, 521 bp, Homo sapiens
ccacgcaactgtagtgccagctactcaggaggctgaggtaggaggattgcttgagtctaggaggttgaggctgcagtgacctacacttgtgccactgcactccggcctgggccacaaagccagaccctgtcccctgccaaaaaaacaaaagggagatggagacttcctcctggatttcttcaacttttttttttaactgtaaattgacagtttataataatgtataaatttatgaggtataaagtgatggctaattcatgaatatcatgtggaataattaaatgaagctagttaatgcattcatcacctcaaatacttaacatcttgtgagaacatttgaaatttcctctagcaatttggagatacacaatactcttatttttttttttttttgagacggagtcttgctctgttgcccaggctggagtgcagtggcgccgtctctgctcactgcaagctccacctcctgggttcacaccattctgcctcagcctccagagtagctgggaccacaggcgccc

SEQ ID NO: 31358 - DNA, 860 bp, Homo sapiens
  misc_feature (1)..(1): n is a, c, g, or t
natttgatatctttggtacaaatttgatatttttgtgaaatcacctcataattttatttagtgttgaagaaacaacattggccccttgccttgttcagacagatttgcgtataatgtaaatatatatattagtggcagaaacaaagtactgtagaaacctagaagagggagaattctgcatgaagtctgggaaactcagcagaaatggcgtttgcaaaggtacagtgtggtatgttgggtgatgggggactttgtgagggacagagtggaaaaatttttaagaggggctgccaaattgcaaaagagaagaattttttttgtcagtgattcctagtctttttggaatcctacaccttctccccagaaaaattcattctagtccagggtttattgtttgttttttccctatatttgacagggtctgtctctgtcacacagtgcagtgggtgcaatcatggcttactgcagactccacttactggtctcaagcaatcctcccccacttcggcctcttaagtagcttggaccacaggtgcacacccaccatgctcagttaattttaatttgttttgtagagatggggtctcactatattgcctaggctggtcttgaattcctgggctcaagtgatccttccacctctgcctcccaaagtgttgggattataggcgtgagccaccacgcttggccaaatctggagtctaaagggtatacaaggtttttttttttcccatgttggcttttatttgatgttataaagtcttcatgatatgaatatattttttaaaaaggtgtcatgtatattgtcatgtaacatgattcatgccacttcattgtattaaatacgtttaagatacagt

SEQ ID NO: 31359 - DNA, 391 bp, Homo sapiens
gtatgtctgacttgtttttaaataacttcctcagcaatgcagaccttaatttttatatttttttaaagtagctaacatagcagtaggcacttaagcatttagtcaatgatattggtagaaatagtaaaatacatcctttaaatatatatctaagcatatattttaaaaggagcaaaaataaaaccaaagtgttagtaaattttgatttattagatattttagaaaaataatagaattctgaagttttaaaaatgtcagtaattaatttattttcattttcagaaatatatgcatgcagttatgttttatttgattgttgacttaggctatgtctgtatacagtaaccaaataaactctttcactattaaagagatttcttactgacacaag

SEQ ID NO: 31360 - DNA, 516 bp, Homo sapiens
gtcatcggcagccttgccagacactgtaccgtggctccagacagtcagctggtactatcgctttgtctcaactataaatcacagtctcgtaatggccaaggctgacaccttgacattttcaagaagagtaaaagacctgatttgaatggaaatcaatttcatttcacaaatcttgggtgactactccaagccttttcttgtgtcttcttgagacttatttgggattttcatgatcatcagaggattatttgagtgttatattatgactttttaaagctataaaaccatattcttacttccttcttcattcctaacatgagaaaattgatttttaaagttttatgtaagaaaaatcactaataagcactgatagtttttaaaatggcaatagcagccaatgctgtttagttttgcaaaacttttgtaaaatgttctctgatttaaaagtacaagctgtgtacacacgtatccagattaacctttgattacctgataataaatattagcaattatcaa

SEQ ID NO: 31361 - DNA, 1220 bp, Homo sapiens
gctaggtttactgactcatatactaaggaagtagctaaaattataaaaataatttgtttttaaaaccatatttaactaagggaactaagtaagttccaatgagcagtggtctcatgcaaggtattttcaatattttaaaatttacagatgaatatttaaatatattataaaagttttaatcagctatctctaagaaaatacatttcttaaagggaaatgaaattcacttgactttaaataaaacaaatgaactcatttcatgtttttaactattatctaactcttccttactttatgatgctggcaagctgttgagagccttgacatctccatctgcagaaaaatcacagtcttagaaatcctattaatcgtgtgaggtacctgggtcatagtagcagcttcatgcagtgttaaaattatatgatgattatatgcagtaacagatgaagaaaaaaagaaagaaagcaggagaaatgcaccacctcattcattgtaaatgcagtatagttgattttttaatttgttttatgtcctctagtgatctaagcatgaagcttgaattattataataaagaaaataaatgcaatgcagttggggatggcaaatgttaatgcttatctgtatcaaagactaacactgtcttcaggattatccttggtggattatccttggcagacacttaatgagcagagagaagctacaatgttgaaggacaaaagtcctttgtcatcttattatcgaaataatgtttaatacaaataaactttttaaattaaaatgtttgactactttttaccactaagaaatattcttggcaaagttaaacaacatcaaaattttaaacaattctttcaaagctaagaagtaaaaacctatgaaattaaaattatgtaattactctgcaggataatttgatgcctctggaaaaatgcatggactgttttagtccctaattctaatttatcacagtagtattaacacgtgcttttttttttttttaagaggatgagggattgagacagtaaacatgaattcctcatagatattggccaagttgtttcattgaacttgttgcaacttaccttgtaattggaaccacaattttatgagacccatatcttgtcttcttttatctatcatgttaagaaataaaccagttccctcttaattatagcatttatttcaaaaagcaatgttaaaaataaatgtagagttagca

SEQ ID NO: 31362 - DNA, 357 bp, Homo sapiens
tggggcccagggcaaaatgcaaatgcaggccccttaaaagtttgtttaaaatgttttcagactgtgacagcagagtatgaaaccaaaaccaggtccttctaagtctaaggctttgtgtgatggcacaggtcacactcctgtacagccagccagccctgtctgttccagcacagggagcccccagggctgcattcaggtcctcaagcggctcttgcctctcccctgctgccccaggaggccatggctgtggttccagagcctggtccagccctggctcagaaatggaggctgacaggatttccccacccgcttggggccctttgagagtttccaggacaaggcccccactgtgcagaa

SEQ ID NO: 31363 - DNA, 412 bp, Homo sapiens
aattgggagaacagctcttacttgacaactggaaaagccttagaacagagaggccccctatgccatacctcagcagagaggccctgttagaacagaatgccttgttttcattgcctgcaggatttcccattgccagagacaaagatgaacctgtttgggtgctgagagatcctacattcatgagtaggccaaaaaaaaagttgcatcccatttaaggaaaccctgtaacttgaaagatagagactaaactgatcaaacagaacagatggaacagaattaatgaaacaggagacaacttacaaaatagaatctcaaggagacgcaataagagtattaagaaatctttttaggactctaaagtaatttacagttttcaaaattcaaaacaggaccaaaaagaaaacaaaagaac

SEQ ID NO: 31364 - DNA, 3443 bp, Homo sapiens
gaggaacatgattttattggttctttcagttcaccacatccgactcgcgtctcggccctggcccgccttgcggaccttaaagcagtcagtccagggtttgggggaaacgtgctcacccgacggcagctcacaggaccccggagagtcctggcatggtatctcggtccggactctccgctgggcccacgaaggagaaaggctgcctcggattcctgcgcccaagccaaggtccggcgcccacggaggcaagtccggtctcacggtgacctcccgctggcgccgccttcgccgccaaccatccagttcttcctccaggccacgttctcctgcgtggtcgctgcctcctgcagagtggccagcaatagctgctgggtcctggccgcctcctccctgctccttgggtcctgcagtggcatctcctgagggcaggaaggggagttcgcaggagctccagtccggggctctccacccgcccacccttcctcgggactaccagttgcttctacctttagcatttcctgcttccgccgctctcccggggtcacgataacgaggagcgcgtagcccacgccagcccctgcgcccagcattgcgactgagatcagcattttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcaggtttagctgagggggttgaggtgtccaagaagtgctggcaccaagggctgagcgcggggaccctgtgtcctcaattccggggtgggattgctagggggagagtgcgtgtcttcatggttgccgtgggttttatgattgcccatttttctgtcttccgacgtttcccgatcagtagaggcccgagctgtgctctgtggtttcctgcagtcacccgcgagttttcaacacagcgcatggagggcatctacacacatacacatccctctccatcccctcaactctggaacaaacactcaaagtcaagtatactggttggagaaatgggtaatagttacttatctttaacatttattttacaaacaacctattccttttctcgtcatggtacacacttggtattgtttgggtttttttttggttttgttgttgttgttagtgtgtgggcgtggttttgtttgtttttggagacaaggtctcgctctgtcgcccagggctggagtgcagtggcgcgatcatggctcactgaagcctcgacttccagggcccaagcgatcctcctgcctcaacctcccggatagctgggattacaggcgtgcaccaccacgcccggctggtattgctttttgttttgcttcgttttcttttttgctttttgagacagagtctcactctgttgcccagctggagtgcagtggcgtgatctcggctcactgcaagctctgcctcccgggttcacgccattctcctgcctcagcctcccgagtagctgggactacaggcgcccgccaccacggccggctaattttttgtatttttagtagagaaagagtttcactatgtaggtcaggctggtctcgaactcctgacctcgtgatccgcccaatccgcccacctcggcctcccaaagtgctgggattacaggtgtgagccaccgcgcccggctgttttgctttgttttcaaccactaaaaggctggattcgtgtaacatactgaattctgctttacagaagaaaacacctcttagctgtgtgactgattataggcaagttcttgtgccccggtttctgcatcagaaaatgaagcttataacaacagtacttgtctcacagttttaggataattaaattagttatatgtaaagcaattaaaacagctcctgccaaagagtaaacaccatataaatattcattaaataacatacaaacataccaggttgggaaaaatcagtaagcataggagtcaggaaattccaagttggttatcacaactcttggcccacagggctttaatccaggtgcccttgtctcctacccttgttgccatcccagtgtctccagggagtaagtagaaataaagatcctatctcacctcttgggcattttcccctgccctgaaagcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcactctg

SEQ ID NO: 31365 - DNA, 163 bp, Homo sapiens
ggcgatggtaagaggattgcttgaacccaggagtttgggctgcagtgagctcagattgtaccactgcactccagcctgggtaacagagccagatcctgtcttaaaataaaagatgggactgaacagatgcctgggcacaacaaagcactgttggtcgcaggaa

SEQ ID NO: 31366 - DNA, 1544 bp, Homo sapiens
agctccgcccatcggagaagcgaccttacagcgcctgcctctttctgagcggcatgaagccacctcccaggcggcgagcggccccggcgcgctatctgggcgaggtgaccggtcccgcgacctggagcgctcgcgagaagcggcagctagtgcgactcctgcaggcgcggcagggccagccggagccggacgccaccgagctggcccgggagctgcggggccggagcgaggctgagatccgggtcttcctccagcagctcaagggccgcgtagcccgggaggccattcagaaagtgcatccgggtggccttcagggaccaaggcgccgggaggcacagcccccagcccccatagaggtctggacggatctggctgagaagataacagggccactggaagaagccctggcagtggctttctcgcaggtgctcaccatcgcggccacggaaccggtcaccctcctgcactccaagccccccaagcccacgcaggcccgtggaaagcctttgctcctgagcgcccctggaggacaggaagaccccgcccctgaaatacctagctctgcccctgctgcacctagctccgcacccaggactcctgaccctgcccctgagaaaccttctgagtcgtcggctggtccctccactgaagaagactttgctgtggactttgagaagatctacaagtacttgtcctctgtctcccgaagtggccgcagccccgagctctcagcagctgagtccgctgtggtcctcgacctgctcatgtcacttccagaggagctgccactcctgccctgcacagccctggttgagcatatgacggagacgtacctacgcctgacagccccccagcccattcccgctggagggagcctggggcctgcagcagaaggggatggggctggctccaaggcaccagaggagacccccccagccaccgagaaggccgagcacagcgaactgaaatcgccttggcaagcagctgggatctgtcccctgaacccgttcctggtgcccctggagcttctgggtcgggcagccacccctgccaggtgaggggcatggcgggcaggaggccacaccaggccccccgccctgcccctcggttctgctcggctggccctggctctttctgaggatcccgtcatgggggaaggtccttgagatgatgctcagctgtggggcgggcctctaagatgccccatactttgggggtctcagaaatggaacccccgttgtacaggggttgggtgggggttgcaggactccactcacaagcctcctgatgtcaaggacaggcggacagggctggcctcccccagtccccaagccccactgtgccttgttgtctgctggggggccatagctggcactgcccaccgtaaaggccctcgcacattttcccccttcctgtacacctcggggccagcatcctcaccttcttcaactgaccagtcgtggttactccctgctgccaggtccttccccttcccgggggtattctgtgaccatgaataaagttatcattctctttctctttca

SEQ ID NO: 31367 - DNA, 429 bp, Homo sapiens
catactttgggggtctcagaaatggaaccccgtttgtacaggggttgggtgggggtgcaggactcactcacaagcctcctgatgtcaaggacaggcgggcagccacccctgccaggtgaggggcatggcgggcaggaggccacaccaggccccccgccctgcccctcggttctgctcggctggccctggctctttctgaggatccccagtccccaagccccactgtgccttgttgtctgctggggggccatagctggcactgcccaccgtaaaggccctcgcacattttcccccttcctgtacacctcggggccagcatcctcaccttcttcaactgaccagtcgtggttactccctgctgccaggtccttccccttcccgggggtattctgtgaccatgaataaagttatcattctctttctctttca

SEQ ID NO: 31368 - DNA, 2079 bp, Homo sapiens
agctccgcccatcggagaagcgaccttacagcgcctgcctctttctgagcggcatgaagccacctcccaggcggcgagcggccccggcgcgctatctgggcgaggtgaccggtcccgcgacctggagcgctcgcgagaagcggcagctagtgcgactcctgcaggcgcggcagggccagccggagccggacgccaccgagctggcccgggagctgcggggccggagcgaggctgagatccgggtcttcctccagcagctcaagggccgcgtagcccgggaggccattcagaaagtgcatccgggtggccttcagggaccaaggcgccgggaggcacagcccccagcccccatagaggtctggacggatctggctgagaagataacagggccactggaagaagccctggcagtggctttctcgcaggtgctcaccatcgcggccacggaaccggtcaccctcctgcactccaagccccccaagcccacgcaggcccgtggaaagcctttgctcctgagcgcccctggaggacaggaagaccccgcccctgaaatacctagctctgcccctgctgcacctagctccgcacccaggactcctgaccctgcccctgagaaaccttctgagtcgtcggctggtccctccactgaagaagactttgctgtggactttgagaagatctacaagtacttgtcctctgtctcccgaagtggccgcagccccgagctctcagcagctgagtccgctgtggtcctcgacctgctcatgtcacttccagaggagctgccactcctgccctgcacagccctggttgagcatatgacggagacgtacctacgcctgacagccccccagcccattcccgctggagggagcctggggcctgcagcagaaggggatggggctggctccaaggcaccagaggagacccccccagccaccgagaaggccgagcacagcgaactgaaatcgccttggcaagcagctgggatctgtcccctgaacccgttcctggtgcccctggagcttctgggtcgggcagccacccctgccaggtgaggggcatggcgggcaggaggccacaccaggccccccgccctgcccctcggttctgctcggctggccctggctctttctgaggatcccgtcatgggggaaggtccttgagatgatgctcagctgtggggcgggcctctaagatgccccatactttgggggtctcagaaatggaacccccgttgtacaggggttgggtgggggttgcaggactccactcacaagcctcctgatgtcaaggacaggcggacagggctggcctcccccagtccccaagccccactgtgccttgttgtctgctggggggccatagctggcactgcccaccgtaaaggccctcgcacattttcccccttcctgtacacctcggggccagcatcctcaccttcttcaactgaccagtcgtggttactccctgctgccaggtccttccccttcccgggggtattctgtgaccatgaataaagttatcattctctttctctttcaaaaaaaaaaaaaaaaaaaaaaaaaaaaaaaaaaaaaaaaaaaaaaaaaaaaaaaaaagggggggggggtaaaatttcccccggggggggccaaagtttatgagctcatcaccggttttttggttggagaagaggcgctcctagatgagagaagctctataatataaaagcaagaggcagaggggagcgctggttaaaaaaaaaggtgtggatcagtgggggaaacaccgttgacagcggaggaaatctgttggggaaaggaacccatatctcttctggtgggggggggcaacaatatagtggggcacaaactatcatccactatagaagaatattatagaagagcacttcgagaggggataataataataaatattttgaagggtgttattagtggttgttctaatacaaacgggtataatttatcagtggtgcgggctgtgaataaaaattttgtgctccatcaagggaagtattaatattgaggaaacaaattttaattacgaggtggatgattgtaaataaaaaataagggc

SEQ ID NO: 31369 - DNA, 1630 bp, Homo sapiens
agctccgcccatcggagaagcgaccttacagcgcctgcctctttctgagcggcatgaagccacctcccaggcggcgagcggccccggcgcgctatctgggcgaggtgaccggtcccgcgacctggagcgctcgcgagaagcggcagctagtgcgactcctgcaggcgcggcagggccagccggagccggacgccaccgagctggcccgggagctgcggggccggagcgaggctgagatccgggtcttcctccagcagctcaagggccgcgtagcccgggaggccattcagaaagtgcatccgggtggccttcagggaccaaggcgccgggaggcacagcccccagcccccatagaggtctggacggatctggctgagaagataacagggccactggaagaagccctggcagtggctttctcgcaggtgctcaccatcgcggccacggaaccggtcaccctcctgcactccaagccccccaagcccacgcaggcccgtggaaagcctttgctcctgagcgcccctggaggacaggaagaccccgcccctgaaatacctagctctgcccctgctgcacctagctccgcacccaggactcctgaccctgcccctgagaaaccttctgagtcgtcggctggtccctccactgaagaagactttgctgtggactttgagaagatctacaagtacttgtcctctgtctcccgaagtggccgcagccccgagctctcagcagctgagtccgctgtggtcctcgacctgctcatgtcacttccagaggagctgccactcctgccctgcacagccctggttgagcatatgacggagacgtacctacgcctgacagccccccagcccattcccgctggagggagcctggggcctgcagcagaaggggatggggctggctccaaggcaccagaggagacccccccagccaccgagaaggccgagcacagcgaactgaaatcgccttggcaagcagctgggatctgtcccctgaacccgttcctggtgcccctggagcttctgggtcgggcagccacccctgccaggtgaggggcatggcgggcaggaggccacaccaggccccccgccctgcccctcggttctgctcggctggccctggctctttctgaggatcccgtcatgggggaaggtccttgagatgatgctcagctgtggggcgggcctctaagatgccccatactttgggggtctcagaaatggaacccccgttgtacaggggttgggtgggggttgcaggactccactcacaagcctcctgatgtcaaggacaggcggacagggctggcctcccccagtccccaagccccactgtgccttgttgtctgctggggggccatagctggcactgcccaccgtaaaggccctcgcacattttcccccttcctgtacacctcggggccagcatcctcaccttcttcaactgaccagtcgtggttactccctgctgccaggtccttccccttcccgggggtattctgtgaccatgaataaagttatcattctctttctctttcatttttttttttttttttttttttttttttttttttttttttttttttttttttttttttttttttttttttttttttttttttttt

SEQ ID NO: 31370 - DNA, 1426 bp, Homo sapiens
gcctcggggtaatgcgtgggtgaggcgagggctaaacgggcggaatgaactgggagtaagatgctgccgagtccgggcgaaaagcaacgcatgctgttggacaggatacgagcttgaaatccgggtcttcctccagcagctcaagggccgcgtagcccgggaggccattcagaaagtgcatccgggtggccttcagggaccaaggcgccgggaggcacagcccccagcccccatagaggtctggacggatctggctgagaagataacagggccactggaagaagccctggcagtggctttctcgcaggtgctcaccatcgcggccacggaaccggtcaccctcctgcactccaagccccccaagcccacgcaggcccgtggaaagcctttgctcctgagcgcccctggaggacaggaagaccccgcccctgaaatacctagctctgcccctgctgcacctagctccgcacccaggactcctgaccctgcccctgagaaaccttctgagtcgtcggctggtccctccactgaagaagactttgctgtggactttgagaagatctacaagtacttgtcctctgtctcccgaagtggccgcagccccgagctctcagcagctgagtccgctgtggtcctcgacctgctcatgtcacttccagaggagctgccactcctgccctgcacagccctggttgagcatatgacggagacgtacctacgcctgacagccccccagcccattcccgctggagggagcctggggcctgcagcagaaggggatggggctggctccaaggcaccagaggagacccccccagccaccgagaaggccgagcacagcgaactgaaatcgccttggcaagcagctgggatctgtcccctgaacccgttcctggtgcccctggagcttctgggtcgggcagccacccctgccaggtgaggggcatggcgggcaggaggccacaccaggccccccgccctgcccctcggttctgctcggctggccctggctctttctgaggatcccgtcatgggggaaggtccttgagatgatgctcagctgtggggcgggcctctaagatgccccatactttgggggtctcagaaatggaacccccgttgtacaggggttgggtgggggttgcaggactccactcacaagcctcctgatgtcaaggacaggcggacagggctggcctcccccagtccccaagccccactgtgccttgttgtctgctggggggccatagctggcactgcccaccgtaaaggccctcgcacattttcccccttcctgtacacctcggggccagcatcctcaccttcttcaactgaccagtcgtggttactccctgctgccaggtccttccccttcccgggggtattctgtgaccatgaataaagttatcattctctttctctttca

SEQ ID NO: 31371 - DNA, 1164 bp, Homo sapiens
  misc_feature (1)..(1): n is a, c, g, or t
nttgacgtttgctaaaaataaagccactgaaaaccgtgcatggttttggagggtcacatggggcaggaaccggtcaccctcctgcactccaagccccccaagcccacgcaggcccgtggaaagcctttgctcctgagcgcccctggaggacaggaagaccccgcccctgaaatacctagctctgcccctgctgcacctagctccgcacccaggactcctgaccctgcccctgagaaaccttctgagtcgtcggctggtccctccactgaagaagactttgctgtggactttgagaagatctacaagtacttgtcctctgtctcccgaagtggccgcagccccgagctctcagcagctgagtccgctgtggtcctcgacctgctcatgtcacttccagaggagctgccactcctgccctgcacagccctggttgagcatatgacggagacgtacctacgcctgacagccccccagcccattcccgctggagggagcctggggcctgcagcagaaggggatggggctggctccaaggcaccagaggagacccccccagccaccgagaaggccgagcacagcgaactgaaatcgccttggcaagcagctgggatctgtcccctgaacccgttcctggtgcccctggagcttctgggtcgggcagccacccctgccaggtgaggggcatggcgggcaggaggccacaccaggccccccgccctgcccctcggttctgctcggctggccctggctctttctgaggatcccgtcatgggggaaggtccttgagatgatgctcagctgtggggcgggcctctaagatgccccatactttgggggtctcagaaatggaacccccgttgtacaggggttgggtgggggttgcaggactccactcacaagcctcctgatgtcaaggacaggcggacagggctggcctcccccagtccccaagccccactgtgccttgttgtctgctggggggccatagctggcactgcccaccgtaaaggccctcgcacattttcccccttcctgtacacctcggggccagcatcctcaccttcttcaactgaccagtcgtggttactccctgctgccaggtccttccccttcccgggggtattctgtgaccatgaataaagttatcattctctttctctttca

SEQ ID NO: 31372 - DNA, 1191 bp, Homo sapiens
gcctcggggtaatgcgtgggtgaggcgagggctaaacgggcggaatgaactgggagtaagatgctgccgagtccgggcgaaaagcaacgcatgctgttggacaggatacgagcttgaaatccgggtcttcctccagcagctcaagggccgcgtagcccgggaggccattcagaaagtgcatccgggtggccttcagggaccaaggcgccgggaggcacagcccccagcccccatagaggtgaggcagatgaacaggctgagaaaccttctgagtcgtcggctggtccctccactgaagaagactttgctgtggactttgagaagatctacaagtacttgtcctctgtctcccgaagtggccgcagccccgagctctcagcagctgagtccgctgtggtcctcgacctgctcatgtcacttccagaggagctgccactcctgccctgcacagccctggttgagcatatgacggagacgtacctacgcctgacagccccccagcccattcccgctggagggagcctggggcctgcagcagaaggggatggggctggctccaaggcaccagaggagacccccccagccaccgagaaggccgagcacagcgaactgaaatcgccttggcaagcagctgggatctgtcccctgaacccgttcctggtgcccctggagcttctgggtcgggcagccacccctgccaggtgaggggcatggcgggcaggaggccacaccaggccccccgccctgcccctcggttctgctcggctggccctggctctttctgaggatcccgtcatgggggaaggtccttgagatgatgctcagctgtggggcgggcctctaagatgccccatactttgggggtctcagaaatggaacccccgttgtacaggggttgggtgggggttgcaggactccactcacaagcctcctgatgtcaaggacaggcggacagggctggcctcccccagtccccaagccccactgtgccttgttgtctgctggggggccatagctggcactgcccaccgtaaaggccctcgcacattttcccccttcctgtacacctcggggccagcatcctcaccttcttcaactgaccagtcgtggttactccctgctgccaggtccttccccttcccgggggtattctgtgaccatgaataaagttatcattctctttctctttca

SEQ ID NO: 31373 - DNA, 1523 bp, Homo sapiens
gcctcggggtaatgcgtgggtgaggcgagggctaaacgggcggaatgaactgggagtaagatgctgccgagtccgggcgaaaagcaacgcatgctgttggacaggatacgagcttgaaatccgggtcttcctccagcagctcaagggccgcgtagcccgggaggccattcagaaagtgcatccgggtggccttcagggaccaaggcgccgggaggcacagcccccagcccccatagaggtctggacggatctggctgagaagataacagggccactggaagaagccctggcagtggctttctcgcaggtgctcaccatcgcggccacggaaccggtcaccctcctgcactccaagccccccaagcccacgcaggcccgtggaaagcctttgctcctgagcgcccctggaggacaggaagaccccgcccctgaaatacctagctctgcccctgctgcacctagctccgcacccaggactcctgaccctgcccctgagaaaccttctgagtcgtcggctggtccctccactgaagaagactttgctgtggactttgagaagatctacaagtacttgtcctctgtctcccgaagtggccgcagccccgagctctcagcagctggtgagaagggtgagggagggggcaggagcagagggatcaagggtccctggcagcaggcaggggtgtccccttacccctctcctccatccatcactagagtccgctgtggtcctcgacctgctcatgtcacttccagaggagctgccactcctgccctgcacagccctggttgagcatatgacggagacgtacctacgcctgacagccccccagcccattcccgctggagggagcctggggcctgcagcagaaggggatggggctggctccaaggcaccagaggagacccccccagccaccgagaaggccgagcacagcgaactgaaatcgccttggcaagcagctgggatctgtcccctgaacccgttcctggtgcccctggagcttctgggtcgggcagccacccctgccaggtgaggggcatggcgggcaggaggccacaccaggccccccgccctgcccctcggttctgctcggctggccctggctctttctgaggatcccgtcatgggggaaggtccttgagatgatgctcagctgtggggcgggcctctaagatgccccatactttgggggtctcagaaatggaacccccgttgtacaggggttgggtgggggttgcaggactccactcacaagcctcctgatgtcaaggacaggcggacagggctggcctcccccagtccccaagccccactgtgccttgttgtctgctggggggccatagctggcactgcccaccgtaaaggccctcgcacattttcccccttcctgtacacctcggggccagcatcctcaccttcttcaactgaccagtcgtggttactccctgctgccaggtccttccccttcccgggggtattctgtgaccatgaataaagttatcattctctttctctttca

SEQ ID NO: 31374 - DNA, 449 bp, Homo sapiens
gagctcatagaagcctcattccgccgcctctttcctttctagatccgggtcttcctccagcagctcaagggccgcgtagcccgggaggccattcagaaagtgcatccgggtggccttcagggaccaaggcgccgggaggcacagcccccagcccccatagaggtgaggcagatgaacagggtgaggctgtccagggcaggtccctggtgggtaggtgggagttgcgggggataacctgattaggggatccccaggaggagcagggcttggggggccattgcaggctgatccctgggctgaccctgtacctctggcttcactcaggtctggacggatctggctgagaagataacagggccactggaagaagccctggcagtggctttctcgcaggtaccgccattcccccaggcaggtcagggtgtcccagaggacagggtcacatgggc

SEQ ID NO: 31375 - DNA, 565 bp, Homo sapiens
caggaaaattagctcattagaacaatgacaccattaagggacattataagggtcctggggctgaggtgggaagatttttctatctgccccatatagtttacccttccttgccttgaaaatgaatattatagaacagagtacagctcttaaaagttattagtatcattattattatagttgttatataatactttaattaagaaagatgaaaaccttttttctttcctaagtcagcccaatggtgctattttacatatcaacacagttgaaaggaagtactgttattttgggctgcagtgtttcctccacatctaaagaaagcccattttgaaactggatactgcattaaaacaaagaaggaaaaattattttaactgtgtgcagtttttgaaattaggcatttgtactattttggttttacataattctcttgcattaacaatttactgttttgtgaatcatgtgtactaaagcaaattaagaaaaagaaaataattatctgtgaaagactttgtatattaaacaagtgacgcaaaccttagttgtggtttccacaatttttgcc

SEQ ID NO: 31376 - DNA, 534 bp, Homo sapiens
caggaaaattagctcattagaacaatgacaccattaagggacattataagggtcctggggctgaggtgggaagatttttctatctgccccatatagtttacccttccttgccttgaaaatgaatattatagaacagagtacagctcttaaaagttattagtatcattattattatagttgttatataatactttaattaagaaagatgaaaaccttttttctttcctaagtcagcccaatggtgctattttacatatcaacacagttgaaaggaagtactgttattttgggctgcagtgtttcctccacatctaaagaaagcccattttgaaactggatactgcattaaaacaaagaaggaaaaattattttaactgtgtgcagtttttgaaattaggcatttgtactattttggttttacataattctcttgcattaacaatttactgttttgtgaatcatgtgtactaaagcaaattaagaaaaagaaaataattatctgtgaaagactttgtatattaaacaagtgacgca

SEQ ID NO: 31377 - DNA, 577 bp, Homo sapiens
caactccaaaacccccttctacacataacaccatgctctcctaatggtaggaggagacaaaaatggcagccgcagttcagttttcagttggtggaatgatttttgtgcacctggtgaaatcactttcacccttaggtattaaaatctccaaacttcatacatgcaattaaaaattattttttatttttaaaaaatctttttccacatgttctatgcaatttttcatacaactcttccttaagaaactcctagaggatgtacgcaattaaaatgaagtcaactcagaaaaacacggctccaggaaagtggtgggttcaatgtaggaaaaaagtgaaggcaatatccaggtgaagagagatgaagagagagtccagaatgacaggagaacagcagccccagaaagcagtcagctcttactggagcaggagagaggactctgctaaatacatctccgcaaagatcaaattgatggaatacctgatgtgtttgaatgcactgagagacttacgcttatggcaaagtttaggggtgtgttaggaataggactattaagccaagcaaacaaaaaataatataa

SEQ ID NO: 31378 - DNA, 334 bp, Homo sapiens
tatttgtagtagagacggggtttcaccatgttagtcagactagtctcaaactcctgaccttaagtgattcacccaacttggcctcccaaagtgctgggattacaggcatgagccattgtgcctggccttaatcttaagtttaaatttaactgggcatcctgcatttttatttgttaaatctggcagccctactttcttcccaacaaaattcttaaagaagagctactatcttgttcacttctgtgtccccactgtaagcacagtatctttacaggctattcaatttttgctgaactaattaataaaaaatatggactaaacaaatataatatgt

SEQ ID NO: 31379 - DNA, 3150 bp, Homo sapiens
gaaaataaagtaagataaacatagtgattaggagcatgaggtttagaatcaatatcatcacctttttgtcctagcagtgccatttaagtagttgtggtactgttgatgagtttcctagatccccacccctttttaatttatttttagaaaaaaacattgattacatataaagcttagaattctccttaaacaactttcctcaatctctgtattttaccctcaagtataatcacttatacgtaatacatctttacacacacacaaccatatacacagacatagatgcagttggttctcattattcaaagagtacagagttaggttcctacaagcctctggtcacaacattttatctactgattaatatataaccacgtattatgtgtgtttctgtttaaagattcctcatttaatatatattgttgattcactaacattaagttcatggtcaacatcactctaactcatacctgaaccaagcttatctaatgtgcatatttttccccataaggcctttttgcacttaggaatgccagacagcactttggcactacatttgggggccattttaaacagtgaagccaccaaaaacacaaaaatgtggcaccaaacagatggtgaaagggctgttgtggatagtaagagctgaaactagaaagcagcagagatcacagagttcagcttcagctggggacgtgtgcatatggtaactcaaatattttgccactttgcacatgtctgcaatgaccacagaaataccacaagtattggtttgggggttacacatgaattttagcaaacaggcaaattcacaaatatggaatctgtaaatgatcaagatcaactgtatatacgcatgcatacactcatataaatatataggtttgtatgggctgttttaatttattatataatgtaaaaacattctgcagcatagtttttttaagttaatgatgtggcttgtagacgtttttatgaagctacactagatcagttgtattcttatgaagtgatacataattattcataatagggatctaccataatttaaccattcgtctaatgatagtgtaagtttcaatttcctcataggtaaatagtaaataaaaataaaagatgtgcctttgagagttaaatgagcttagtacattgccctacaacttaagcacttaatgagtgtgagttaataaaaattaaagggctttggagtcagacagacatgggttccacattccatctcttccctccctagctgtgagacttcactgaattactgaatctctttctgtgtaaaagaggtagatgaagaacaaaaatagtaataaccttaagattattgaatctctctaagtcatctcatctgaaactggagattataatacttcattgtttgtgtgacaatgaaatgtaatcatacctaaagtacctaccacacaggaactcagtgttttttccttcttagataatttgatctcaagaaaatggtgttactttataaagagtagcattacagaatcaatatcttcttttaaaaatataacacagcattgtacttctacatactcagaacgtaagagaaagaactaagccattttagtacagtgcttagactgtatactttcagtgaggtatagtctacaaacaaaagcaaagaaatgttgagtttggttggtagtggtacatatatagcaaatctagaactcttatgtattttaagttgagcaaatgagtacatatgatgttgctgggagtcagggttttcttggtggaagaaaggagatatggaatggaataagagaaggaagaatcctctggggctttaagaaattagaattaacaataaaagcatgaactataatagtgtaaaacaatgtatgcatatgataggcatatatgcataggcctagaaacaatgacaccctggcaattagcacagctgttcttgtttggtttttaaataatagtcacagctaaaagaaagtaggactccagagctgtgtaaagatgaatttggatatataccagaaagtaaggaagtaccccaaaattaatgggtacatttcaaaaagacacagaagccagctcaaaaaggctctcactggtcaaatctaggacaatatgagtatcagaatgaatgatgacagtaatgagtataacattgagcaagagaagaatccctgagtacacagtgatgcgaacaaataagtaaaatgggaggaggggaagaaacagctcttctttacaatagaatgtcaacaactgtagaaggagtcatagagtcagaaaatcaccatcatataactgataattgtttcagcaagaatcatcaatgattgctaaattattggatgcagggctgtgggagaacaggatatttacacagtctcaaactatctccctatcaatagtttattaattacaaaggtagaaaagaacacctttaccttggagaaacttggcatataccaacttaagtagatgatcaaagttaacatcatcagtattgggataaactgataccacatgccttctgaggtgatgcactgaggacacacaatatcacttctgtagcattcttgccaaaactgcataaactgaatctgatcatgaagaaacaatcaggcaacccaaattcaacacattccactcataagtgttctgtactcttcaaaaatattcattaaagtcaaagagaggctgaggaactatttcaaactcaggagacttggaaactaaatgcagtgtgtgatcttggattggattttagattagtaggaaacatgactgtaaaaaagtgactgaaaaataactggtattattgggacatcaatgttaaatttcatgaatttaatatatattggttatgtaagttaatgttcttgttctgagctgaaattagtttgagcctatagggggcaaagctgtctaaaactcccaaatagttctgcaaaaagattttcagtggggtacacacatggagagagacagagagagagagagagagagaacatatttgatgaaacattaattgatgagatgaatctaagtgaaggctatatggggtgttcattgcacaattcttgaaacttttctgtgggtttgaaatttttcaaaataaaaagttgaaaaagaagcaatttggaaatttca

SEQ ID NO: 31380 - DNA, 2337 bp, Homo sapiens
  misc_feature (1452)..(1452): n is a, c, g, or t
  misc_feature (2035)..(2035): n is a, c, g, or t
  misc_feature (2148)..(2148): n is a, c, g, or t
  misc_feature (2164)..(2164): n is a, c, g, or t
  misc_feature (2200)..(2200): n is a, c, g, or t
ctaagacaccagatatttgttattttgtagttcgagtattttttaaaatacgaaattggcttttcggtgtgtgaaaagggctacttactagacgcttgtttttaaattaacattcaattaattaaagctagactctttatattcttaggcttggtatactatttatatgttttgtaataagtgtataaaaataatacctttgactttgtgtaaaaataatgcttttgacttgttctttgatgaatgtttattaaaatcccccaaaacaactaatgccattaataattttagttaagtcctttaaacattccagactacacatgtaaatttaatatatcaaattgactcaaccactccaaaaaacctaataaagtataagcactgaagtaatcaataaatcaaaattgtagaaattataagtcagagtctaacattcaaatactgtttacaacgtgaattagctaacaccttaacgaattcaaatcagttacacacataaaaattacaaagtcaagataacttctcattctggcagtgtggcagaccacgattaacttgaaaatctatctacaaagatttaaaaaaatggaaaaactaagaaaggacaaacccccagtgccaaaaatgaagtaggagccagcatggcaggcaaagagctaacttgccagctaccctggagaggagggcatacaccttttttagacacctgggttttattgctcaagtaactgtgtagggaccagagataaaacgtacggaccattaacgccaggtaatgggaactgagactcttaacataaattctagacttaatgtgttatggagttaaaggactgtacattatgtgaaggaatgaactggaaaaaaccttagtaccaacataagagatgacaaggtaacatggacgtttaggctccaggaaactttaagacaaattaacgtaaaaatggtttctgggctggtaatacccttggtgtttctgttaaaaacatgaagaacggctgggcgtggtggctcacgtctgtaatcccagcactttgggaggccgaggcgggtggatcacctaaggtcgagagttcgagaccagcttgaccaacctggagaaaccccatctctacttaaaaaattaaggcatcctacatgcctgtaatcccagctactcagaaggctgaggcaggagaatcgcttgaacctgggaggcggaggttgtggtgagccgagattgcgccattgcactccagcctggggaacaagagaaactctatctcaaaaaaaaaaaaaaaaaaaaaacctgaaaaacattttctggaggaaatttcatggtttagatcacaaggaatttcagataaagcaagccttgcaaaagatatgttcatagtaaattgcagagctttaggaaacatttcactgaaatgagagtcaatgacaaataggattagagcctctaacagnttatctgagagaatatttttatgtttaaaattgttaaaataaacctaaaggaaggaatcaaccctaagatcaaggttggccgggtgcggtggctcatgcctgtaatcccagccctttgggatcctgaagcaggtggatcacctgaggtcagaagttcgagaccagcctggccaccatggcgaaaccccatctctactaaaagtataaaaattgccaggtgaggtggcgggaacctgtaatcccagatccttgtgaggctgaggcaccagaattggttgaagctaggaggcagaggttgcagtttgagacactgcactccagcttgggtgacagagcaagactctgtctcaaaaaaaaaaaaaaaaaaaaaagatcaaggtgttaataaaacaagccacatagatttgaaaaagaatcaagtaaaacgtttagaattaattaggaaaagtgaataagttggaatagcagacctagcagaagaaagaattacagatatgatggatgtgacttatctcacagatgtggaaggtagatgtgatcttccagcattcaattcagggggataagatatgaaaatgaaagntttcaggcatggtggctcatgcctataatcccagcactttaagaggctgaggtgggtagatcgcgtgagctcaggagtttgaaaacagcctgggcaacgtgatgaaactcccntctctacaaaatacanaaaagatcagctgaatgtggcggtatgcatgtgtantcccagctactcgggaggttgaagtgggaggattgcttgagcccaggaaatcgaggctacagtgagctgtgattgtcctacagcacttcagccttggcaacagagcgagaccctgtcccccccccccgcaaaaaaag

SEQ ID NO: 31381 - DNA, 407 bp, Homo sapiens
tatactctgtgatgtttgcacaatgaagcagttgcctaatgacacatttctcagaatgaatcctgttgtcaagtgacacatgactttatttgataatgaatacaagaccatttcatcttgatcccagatagatacattgagatgcattgatgttctctaagtgaacgtgactcatcctgttctttattagttattgactgtttccgtagtcacctctactttttgatcgttcaccaggttttgaaatcactgtgtaggcagcacccactatgcagttcaaaactttatgtaggcctgttttgtactgggctccaggttcagtgctggcaaataaacaagttccttgttctcacagaatgtgtatggccttgggtgccaggcaccgttccatgccttaacctacattc

SEQ ID NO: 31382 - DNA, 446 bp, Homo sapiens
aaaaaaaaatggaataaacaggtaatttctcatccagttaggttgtgactgaagaaatgcacagccccaaagaatattaccaaaatgatgcaggcggggcaagccttgtgaactgaaggacaaaatgcttttgtgagtcctagaactgttttggtttgcatgtcatacttttccgattagtgaaatcaagtgtctttgagttgtttctgtgtattgaaaccatctacacatttggtaaatactacgggttaaatctttctctttagataaaatcttcaaagtaagtgattttcaaaatttaaaaaagctctactagaaactacttggttaagagtctaatgaagctcagaaatatttactttgatctcttgggtaaatggctaattaaaaagccgcatgtaaatgatgtttccctgtgagtccctgtgctgtcagcccgagtcaat

SEQ ID NO: 31383 - DNA, 357 bp, Homo sapiens
aggaggccataggggtgtggtgtggcagtgggaagaaagacaagtgcagtccaagagcagaggctgacaataagaaaggtgcagcaagggtccaaagatcatgatgaagtttggagtcataagactcagtgtggaaaaggcagagtacagagcattgttttcatctcacttctaattaatccttgtttagatcagcatttgtctaaccattgaggagtccataatggggtctacagaagaggccttgaggttaaaataggggtgagagatagaggctgaggtgtcaggtggcaagatttgttttgtagattagtacctgcctcacctttaaagcaaggcataccctaagaaaaaaag

SEQ ID NO: 31384 - DNA, 323 bp, Homo sapiens
acaagtttattatatatagtttatggtcatatgtatcttataaaaattttgaagcccatccccatggatttattataatacagctctgatatatcttaaagttaacccgttttccgtagatgttaagggctttactggttgaggtaacctatttcaaatggtctgttgggttttgtggtaccttgtcaagaattcaataagaattctcaggctgtctgtattttcttttaggactttggagatctctcaagttgtactgttttctagtattcctgagtatattcctttggtaacgtgaaagtaaatagtttatatttgatgat

SEQ ID NO: 31385 - DNA, 1162 bp, Homo sapiens
gtctcctgggctcaagccatctgcttgcctcggccacccgaagtactggggttacaggcatgagccaccgtgcttgtccagttttacctgtttttgaacctcatataaatggaatcatagagcataaaagctctttgatgtctgatttcttttactcagcaaaatggttttgagattcatctttgttcttgcatatatcagtagttcctttttttttttttaatttctgtgagaattccactatgtgaatataatgcaggggtttttgcttcttagttcaactaaatccaggttcttgtctcacaaccaggagaaattaggcatatggacacattgaagggtgaggagagtggaatttattaagcgaaaggggagctctcagcaaagagaggggtcccgccagctggcttccacctcaggttgaataccaggccaccacactccctagcctaaggcgtgaattcctggtggctccacccccttcccccagtgtgcagacgggcccttagtctgagccgctccacgttgatttatttcccttactgcacatatgttaagtgatggaatttttcactgtgggcgtatttaggcaagcctcctgtgcatgatgacctgggcaggtcgaaggttctccggggacccttccctctttgcctaggcattttgccgtctcttgactcttatcaaatatataacagtatttaaaaattgattctcatgttgatggacatttgggcacttttcagtttggggctattatgaataaagctaccacgaacatttatgtgtaagtctttgggtatatgtatgtttcattcaatccatgactaggagcagaattgctgggtgataggatatgtagatgtttaactttataagaaattgttcaactgtttttcaaagtgctgtaccaccttacactctgatcagctttatattagagttcatttgcctcatgtgtcagccaaactgacaacacgctgggtgttgtcagtttttaattttaggtattcttgtggactagtatttcctcattttaattttgttattgatccagtgattggtggtggtgagttttttatgtgcttaataggcattcacttatcttcttttgtgaatgttaagtcttttgtctattcttttaaagttgtttttttaaaaa

SEQ ID NO: 31386 - DNA, 132 bp, Homo sapiens
cttataggactgaacctaaaggcatgacatttccatacttgtcacaagcacacactgattctgcccttgtcacttctgtgctcactcttgtggctctatcctcctcctgcccttccgccttccactcctccc

SEQ ID NO: 31387 - DNA, 292 bp, Homo sapiens
caaaaattagccagacatggcagtgcgcgcctgtagccccagctactggggaggctgaggcaagagaatcgcttgaacccagtaggtggtggttgcagtgagccaagattgcaccactgcactccagcctgagcgatagagactgcatctgaaaacaaacaaacaaaaagaataagataccattggaaatttactcatgcagctttcatgatgtaaccaggcatggtggtgcacacccgtagtcctagctcctcaggaggctaaggtggggaggattcattgagatgaggag

SEQ ID NO: 31388 - DNA, 361 bp, Homo sapiens
gaaaacgtttacaagaatattcagtgaagcattatttgcaagagtgaatagaggctcatcatccagagactggataaattgtggagtataaatataacggaacactacacagcatctaaaataagctaactagaactgtattcattgacttgaacaaatgccaaaaatgatttaagtaaaaagcatgttgcagaatgatacataagtatatgcagtttaaaaaaagtgcaaaacaagctgaggtgcagtggtgcgcacctataatcccagctacttgggaggatgaagtggaaggattgattgaggcaaagggtttgagactatcctgggcaatcataatgagatcctatctcaaaaaaat

SEQ ID NO: 31389 - DNA, 769 bp, Homo sapiens
tgatccacccgccttggcctcccaacgtgctgggattacaggtgtgagccactgcactcagccagtgtggggagatcttacctggagaaaaggagaggcctgagaacacccagccttcccagcactctggggctgtagcctctcaactcttcttggctgctcttctgagaataaaagaattctcacataccaatttcagggggcacagctggaaaatagggagcagtggtgattaagaactctgcctccttctagctgctctgagccacagtttctttataggcaaaaggaaatactcatagtgtatgtttccaggttgctgtgagataatgtagcataaagaattgagagggcagtgctgggaacataccaagcagggatgaacttgaaaaacatgtaacaaccagtaagggcagaggaagctccttctttgtagattggaggtcaagattgtgctggagcaggttctggagaacacttcagtgccagcattaaccgattagctgctgggctgtggggagtttccagagaggcattgggtgaggaagaggggtgatgctatttataatcaactatgaaattatttaaatattttaataataagctatggctgtatactatgtaaatagtaactgtagttctaagtattagtaaatattaatggttaattagtataaagattagctatagggcttttatagctagattccctcttccccaacacgcacacatatacctccattcttatttatttatttaatttattctt

SEQ ID NO: 31390 - DNA, 478 bp, Homo sapiens
atataacatcagataggcctgggttttaataccatctctgctatctactccaagtatgggaatttaggcaccttcccttttctttctgagctttatttttcttttccattaaatagtataataagtacccccatttgatttttagatggactctgagataatgtactacatgccaggcaccttgtggtactcaaataaatgtctactattatgtacatatatttctctttttgtggggaactggtacaagtagttctcatgtagttataaaaccacagagaatacattgaaggaactccctatttttaaaagcctgtatcaggaatgccctggataaactagagtctttgtttatcagactctaatgattaatcagactctcattcttatattgagtgacaggcagcaaaacaaaaaaagagtatttggctgttaaaaaaagagagagagatgtcctatgagtcaccagagggttaaa

SEQ ID NO: 31391 - DNA, 385 bp, Homo sapiens
aaaatgccatggtacaaaaaaaaaatcatcttttatttctcacgcttgctgggcagctggggattagctgttctcagctgggtttacctggcatgactctgctttagggtgtcttaccctccttggagcagctggctggcccagggaagtcttctagcattggtagaagtacaagaaggcaagcagaaacacatgaagtctcttaaggcctaagtgcagaactgaacacgattacttccatttcattctgttgaccaaagcaaatcatgtggctgaacccaaaatcaacgggtagggaaatatactccactccttcagtggaaggaacttcaaagtcgtagcaaagggcatggatacagtgcatgatgaagtcctggggccaata

SEQ ID NO: 31392 - DNA, 298 bp, Homo sapiens
aatcaaatgcccagtgataatttaatgtgtcatttactcttgcaaaagtatacatttttacccataatgaagaggacactaattcaagaaagtatcatagaaaattagatattttttctactctgaagcaatcactgattgtcagtggattctatacactaaattatttcagaattcatacacctgaaaattgtcaaatatataaactctaattattaaattattgatatttagaagaaggatttgtgaagcatttgtgccagtttttccctgtcatttatatatcaaaaaagtactc

SEQ ID NO: 31393 - DNA, 1037 bp, Homo sapiens
gacggtggccgacaggctgcgcccgcccgcgcccggggtgatgcagttgccccccgcgctgtgcgcccgcctcgctgcggggcccggggcggcggagccactgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatgcccagcctcagcagaagccccaggggacagtggagagcggtcagaaggggaggccatggaaatctgctctgagcctgtggcagcctcccctgcaccggcaggtgagaggcggatctacagacatagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccttcgccatcctccccatccttgttcctcagcaaatggcattagcagctgtcatcagaagctgtgagggacccacagattttggaaacgacctggacacactatttgggaaggagatgtggacggcctgtctcctcctgcagggcccaccctaagaatgtatttttaaacacatgaaataagtatttttcactgaa

SEQ ID NO: 31394 - DNA, 1096 bp, Homo sapiens
gacggtggccgacaggctgcgcccgcccgcgcccggggtgatgcagttgccccccgcgctgtgcgcccgcctcgctgcggggcccggggcggcggagccactgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacatagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccttcgccatcctccccatccttgttcctcagcaaatggcattagcagctgtcatcagaagctgtgagggacccacagattttggaaacgacctggacacactatttgggaaggagatgtggacggcctgtctcctcctgcagggcccaccctaagaatgtatttttaaacacatgaaataagtatttttcactgaa

SEQ ID NO: 31395 - DNA, 824 bp, Homo sapiens
  misc_feature (797)..(797): n is a, c, g, or t
  misc_feature (806)..(806): n is a, c, g, or t
  misc_feature (820)..(820): n is a, c, g, or t
gacggtggccgacaggctgcgcccgcccgcgcccggggtgatgcagttgccccccgcgctgtgcgcccgcctcgctgcggggcccggggcggcggagccactgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggaataccctctaccatctgctttggtcagggtgccgctcgaggatttaaaagcaacaagaagaaaaccaaacaatgctgatagactcagaaaaggagtgganacagtcagnctgctggctatganttta

SEQ ID NO: 31396 - DNA, 543 bp, Homo sapiens
  misc_feature (23)..(23): n is a, c, g, or t
  misc_feature (38)..(38): n is a, c, g, or t
gtaaagaagtatgtgcaggaggngtggtacacaggganctcgtttcctattctgtgaaacagaagacattgtgatggagtggttcttcagctactggatggaaacatatgcctgttgatttgctgaaaaaacaaaaaaaatgaagaatgtgatctctgcagtacagttaccttaattactgtaatgtgcctaaatagtaaggctgccttctcaatgtaaccctctgtgcttaaaaaatttcattttgtgtgctttgtattcactacacaggaataagcactttttaaaaatgcagatacatactgcagttccctgataaaagctgaaaagaaaatttgagtattttaagttaagatgtgataaaaaatgtgcatgtgccataatcaaatatatatgaaaaggcagtgttccttgtatttatttttttttctttttgtggcaaaagaaacttaaacatactgtttcagtcacattgcattgtagtgtatggcctgtttcttgtatctttaaagacgttgctcaataaaacaaatcttgcaactg

SEQ ID NO: 31397 - DNA, 6922 bp, Homo sapiens
gacaacacctcacaaaagaaactgcagagatgttaaatcaactgcacattaaaagcagtggatgctttctttacctagaacgagttttagatggagttgtagaaaattttattatgttaagagaaattcgtgacatcccaggaactctaaatggtttatatctctggctgtgccaaagactttttgtaagaaaacaatttgcaaaggttcagcctattttgaatgtgattcttgcagcctgccgacctttgaccataacggaattatatcacgcagtatggaccaaaaacatgtcgttaactttggaagattttcaacgcaagttagatatcctctccaaacttcttgttgatggactaggaaatacaaaaatactgtttcattatagttttgccgagtggcttctggatgtgaaacactgtactcagaagtatttatgtaatgcagcagaaggacacagaatgttggctatgagttatacctgtcaagccaagaatttaacaccattggaagcacaagaatttgcattgcacttaattaactcaaacttacaattagagacagcggagttagctctgtggatgatatggaatggtacacctgtcagagattccctttctactttgatacccaaggaacaagaagtgctacagctgttggttaaagctggggctcatgtcaacagtgaagacgatcgcacatcatgcatagttcgacaagccttagaaagagaggatccattcggacattattagataatggagcttcagtaaatcagtgtgattcaaatgggagaacattattggctaatgctgcatatagtggcagtcttgatgtagtcaatttacttgtctctaggggagcagatttagagatagaagatgctcatggacatacaccactcactctagcggctagacagggacataccaaggtggttaattgtttgattgggtgtggagcaaatattaatcatactgatcaagatggttggacagcattaagatctgctgcttggggtggccatactgaggtagtttctgcactactttatgctggcgtaaaagtggattgtgcagatgctgatagccgaacagctttgagagcagcagcatggggaggacacgaggatattgtactgaatttgctacaacatggcgctgaagtgaacaaagctgataatgaaggtagaactgctttgatagcagcagcatacatgggacatagagagattgtggaacacctactggaccatggagcagaagtaaatcatgaggatgttgatggcaggactgcactctctgtagctgcactttgtgtgcctgcaagtaaagggcacgcatcagttgttagccttttaattgatcgaggtgctgaagtagatcattgtgataaagatggcatgactccactgctggtagctgcctatgaaggacatgttgatgtggttgacttgcttctagaagggggagcagatgtagatcacacagataacaatggccgtacacccctcttagcagcagcgtctatgggtcatgcatcagttgtaaatacacttttgttttggggtgcagctgtggatagtattgatagtgaaggtaggacagtcctcagtatagcttcagcacaaggaaatgttgaggtggtacgtactctactggatagagggttagatgaaaatcacagagatgatgctggatggacacctttgcacatggcagcttttgaagggcacagattgatatgtgaagcacttattgaacaaggtgctagaacaaatgagattgacaatgatggacgaatccctttcatattagcttcacaagagggtcattatgattgtgttcaaatattactggaaaacaaatccaacattgatcaaagaggttatgatggaagaaatgcactgcgggttgctgcattagaagggcacagggacattgttgaattgctttttagccatggtgctgatgttaactgcaaagatgctgatggtcggcctacactttatatcttggccttagaaaatcagcttacaatggccgaatattttttagaaaatggtgcaaacgtagaagcaagtgatgctgaaggaaggacagcacttcatgtgtcttgttggcaaggccatatggaaatggtgcaggtcctgatagcataccatgctgacgtcaatgctgcagacaatgaaaagcgctctgctttgcagtctgcagcctggcagggccatgtaaaagtggttcagcttctgattgagcatggtgctgtagttgaccatacatgtaaccaaggtgcaactgcactctgtattgcagcccaggaagggcacattgatgttgttcaggtcttattagagcatggtgctgatccaaaccatgctgatcaatttggacgcactgctatgcgtgttgcagccaaaaatggacattctcagataattaaattattagaaaaatatggtgcatctagtttgaatggctgttccccatctcctgttcacacaatggagcaaaaacctctacagtcattgtcttcaaaagtgcagtcattaacaattaaatcaaatagctctggtagtactggtggaggggatatgcagccttcgttacgtggtttacctaatgggcctactcatgcttttagttctccttcagaatctccagattctacagttgaccggcagaagtcatcactgtcaaataattccctgaaaagctcaaaaaattcatctttgagaactacttcatctacagcaacggctcaaacagtgccaattgatagctttcataacttgtcatttacagaacaaattcagcagcattcattgccacgcagtagaagtcgacagtcaattgtttccccatcttccacaacacagtccttaggacagagtcataattcaccaagtagtgaatttgagtggagtcaagtaaagcccagtttgaagtcaactaaagcaagtaaaggggggaaatcagaaaattctgccaagtctggatcagctgggaaaaaagcgaaacaaagtaattcttcacagccaaaggttttagaatatgaaatgactcagtttgatagaagaggacctatagccaaatccgggactgctgcaccacctaaacaaatgccagcagaatctcaatgcaaaattatgataccttcagctcagcaggaaattggtcgatctcaacagcagtttcttattcaccaacaaagtggggaacagaagaagagaaatggaataatgacaaatccaaattatcatcttcagagcaaccaggtttttcttggtagggtttcagtcccacgaacaatgcaagatagagggcatcaggaagtgttggagggatacccttcctcagagacagaattaagccttaaacaagctctgaagcttcagattgaaggttctgaccctagcttcaactataaaaaggaaacaccattataaaagtttcctattctgtgaaacagaagacattgtgatggagtggttcttcagctactggatggaaacatatgcctgttgatttgctgaaaaaacaaaaaaaatgaagaatgtgatctctgcagtacagttaccttaattactgtaatgtgcctaaatagtaaggctgccttctcaatgtaaccctctgtgcttaaaaaatttcattttgtgtgctttgtattcactacacaggaataagcactttttaaaaatgcagatacatactgcagttccctgataaaagctgaaaagaaaatttgagtattttaagttaagatgtgataaaaaatgtgcatgtgccataatcaaatatatatgaaaaggcagtgttccttgtatttatttttttttctttttgtggcaaaagaaacttaaacatactgtttcagtcacattgcattgtagtgtatggcctgtttcttgtatctttaaagacgttgctcaataaaacaaatcttgcaactgttctatgttcactacaccttcagcattggataaaaatcattttctatataaatatcacattgaaatgaaaaaatgatttcttggcagtttaaaaaaaatattttatagtagtttagggagctgctttaagtagtttaaatctggattttcccagtagaattcttctcatctctggctaaacatgtcagaacaaacaaccaaccagtctgtaggcagaacaaagtcctatttcatccgctgggatacaatttcatcttccattcactttgtcattccacctctaagaagacagactatcattcctgaggcatgaaaattctcagggacaaagccatgcctcagtcacatgtgtgtgcagagagaaatgcacctgtctatctaagggtagatttttgatccctgaataattcattgactaaactgacctcttcctcctggctaaataaattaattttgctggcttctctctcagcggtttctattttgtaaattgctgcatgaccaaaatagccccactcaaaatcaattggattaattttaatggtttggttggatgaatattctggatgaatataaaatgtgctgcccttcacagatgacaccactcccctgtcaatcatagcacatgtgtactttttattgttacttaatagtgatggatttgcacttttctatcctcatactctttcctgttttcttctttgtacaattgcatgcaggagggctggatgccagggttaagagagaaattcatgacaaggaaggtaaaattggttcaaatgagcatgtgtcccacagccttagtctccttactcttaaatcagtggagctgtagcttagatgggtcgtttatatgtctggaaaagttgtcataacagtttagaagccaaggttgtggatttgatcttagaatgggcctgttaatcttatagaacccagaaattctgttcttttcatgtactgttgatgaggaatgaggaaagagaatttggagattcagcacaaaaccattgctacttctagaacaaaatctttagaatatgtcctaataacaaaggtcagtaatgtcatcttcatatatgaaggacacatgtgatacattgttcgtggaaatagaaatgtataattatgataaatgtttcacttgaatcttattgtaaggcttttcttgcttttattttttaaagtcagcaaaactcattttgtctgtcatctataagtcatagtgaggactacgagataagttgataagttcaattgatattaaggtgacatggcaatattaataactcaaatgtgaatgtttcaagtattgaattcttgtccctatgggacatttattaaataaaattaatgggactcttgcaaagtagccttaaaagtgttaatgagtctattaataaatatgaacacatactattattagaaccaactttactcatatctcaaatacagtacatttacattactgtagaggatgaagctctaatttctattacatgtaattttctttagaaagagaaccctgaaagctgccagtttttctattaactttgaattattgaaattgtatttatttaattttattgtttttacaaaattgcaccttgtgtccaaagggcgaagatatgacattgcataagggatttatgtttttcaaagagctaactgttttcatatccatactatatacacttgaagcaattggtaggaagagaacctattggaaaaatacgattttcaaaagtaagtattcctcgggatgtttttatataaattatgttttggaatagaacataaatgactttgagttaggataaggatgataggatgggtgctggagatgccctgccttgcttatttgtttctgtgggggatttaatactataaatgaaaatggcttctgctccattaaaaagtaaaaattgtcctccaaatataaaactccttaatagatatttttgaaattaaaatctttaaattttataaatcagctgttgccactacacaactatgatggcatgtgcttataacatttttataacattccgtctgtgtctattccctaaatatcatgagtttataataaggaaagtgataaaaatacagtaatgaaataaaaatctgaatgtttctaagaaaggttttggaaggaaaaatgacctgaaatcagtgcgtactgcaaagtacagccaataatttttgttctttgttttcacccccaccctcactggaattctcaccaaaaatagtttgatacttaaaaaacagaagtaaatacttttctcaatattgttttggctatgcaaatatttgttttgcttaatgtcctccatttacacttctcagcaaatgtagttgcaaacaaatgctttctttttatttttcccttggtttgaggtatgtaaatagccaaaaatgtacattgaatttcacattgtaaaagttttattttatcccttgtatgatattactcaaaaaatccctgtgtatatgaaagtgcataataaatatatttgctttacagagaagatcttgttttaattttgtccttgaaccagtagaacatgcatgatatgcatatagcataaacaactgttagttgttttaagttattatcttaaataaatcctgagcaaatgaatttggaaacattttgcaaagaagaaagtgaaatataacactgtccaaaggaaggtagaaaaacaaagatttactgtttatgtcttcctaagcctttttaaagacttaatgttcttttcccccccgtgactgattatatactatatcacaccatgtcaggttttgtgcctctgagaattgcagtaatccaataacttttgtatatgtgtgctccttgatcatcagaatattatggccatcttatggcggatattttgggagtttattgcaaacatggtcattcattttctaaataaaatttgtgtgtttcttcactcagtaaaaaag

SEQ ID NO: 31398 - DNA, 6103 bp, Homo sapiens
gagacaagtaaattgactacatcaagactgccactatatgggagcagatttagagatagaagatgctcatggacatacaccactcactctagcggctagacagggacataccaaggtggttaattgtttgattgggtgtggagcaaatattaatcatactgatcaagatggttggacagcattaagatctgctgcttggggtggccatactgaggtagtttctgcactactttatgctggcgtaaaagtggattgtgcagatgctgatagccgaacagctttgagagcagcagcatggggaggacacgaggatattgtactgaatttgctacaacatggcgctgaagtgaacaaagctgataatgaaggtagaactgctttgatagcagcagcatacatgggacatagagagattgtggaacacctactggaccatggagcagaagtaaatcatgaggatgttgatggcaggactgcactctctgtagctgcactttgtgtgcctgcaagtaaagggcacgcatcagttgttagccttttaattgatcgaggtgctgaagtagatcattgtgataaagatggcatgactccactgctggtagctgcctatgaaggacatgttgatgtggttgacttgcttctagaagggggagcagatgtagatcacacagataacaatggccgtacacccctcttagcagcagcgtctatgggtcatgcatcagttgtaaatacacttttgttttggggtgcagctgtggatagtattgatagtgaaggtaggacagtcctcagtatagcttcagcacaaggaaatgttgaggtggtacgtactctactggatagagggttagatgaaaatcacagagatgatgctggatggacacctttgcacatggcagcttttgaagggcacagattgatatgtgaagcacttattgaacaaggtgctagaacaaatgagattgacaatgatggacgaatccctttcatattagcttcacaagagggtcattatgattgtgttcaaatattactggaaaacaaatccaacattgatcaaagaggttatgatggaagaaatgcactgcgggttgctgcattagaagggcacagggacattgttgaattgctttttagccatggtgctgatgttaactgcaaagatgctgatggtcggcctacactttatatcttggccttagaaaatcagcttacaatggccgaatattttttagaaaatggtgcaaacgtagaagcaagtgatgctgaaggaaggacagcacttcatgtgtcttgttggcaaggccatatggaaatggtgcaggtcctgatagcataccatgctgacgtcaatgctgcagacaatgaaaagcgctctgctttgcagtctgcagcctggcagggccatgtaaaagtggttcagcttctgattgagcatggtgctgtagttgaccatacatgtaaccaaggtgcaactgcactctgtattgcagcccaggaagggcacattgatgttgttcaggtcttattagagcatggtgctgatccaaaccatgctgatcaatttggacgcactgctatgcgtgttgcagccaaaaatggacattctcagataattaaattattagaaaaatatggtgcatctagtttgaatggctgttccccatctcctgttcacacaatggagcaaaaacctctacagtcattgtcttcaaaagtgcagtcattaacaattaaatcaaatagctctggtagtactggtggaggggatatgcagccttcgttacgtggtttacctaatgggcctactcatgcttttagttctccttcagaatctccagattctacagttgaccggcagaagtcatcactgtcaaataattccctgaaaagctcaaaaaattcatctttgagaactacttcatctacagcaacggctcaaacagtgccaattgatagctttcataacttgtcatttacagaacaaattcagcagcattcattgccacgcagtagaagtcgacagtcaattgtttccccatcttccacaacacagtccttaggacagagtcataattcaccaagtagtgaatttgagtggagtcaagtaaagcccagtttgaagtcaactaaagcaagtaaaggggggaaatcagaaaattctgccaagtctggatcagctgggaaaaaagcgaaacaaagtaattcttcacagccaaaggttttagaatatgaaatgactcagtttgatagaagaggacctatagccaaatccgggactgctgcaccacctaaacaaatgccagcagaatctcaatgcaaaattatgataccttcagctcagcaggaaattggtcgatctcaacagcagtttcttattcaccaacaaagtggggaacagaagaagagaaatggaataatgacaaatccaaattatcatcttcagagcaaccaggtttttcttggtagggtttcagtcccacgaacaatgcaagatagagggcatcaggaagtgttggagggatacccttcctcagagacagaattaagccttaaacaagctctgaagcttcagattgaaggttctgaccctagcttcaactataaaaaggaaacaccattataaaagtttcctattctgtgaaacagaagacattgtgatggagtggttcttcagctactggatggaaacatatgcctgttgatttgctgaaaaaacaaaaaaaatgaagaatgtgatctctgcagtacagttaccttaattactgtaatgtgcctaaatagtaaggctgccttctcaatgtaaccctctgtgcttaaaaaatttcattttgtgtgctttgtattcactacacaggaataagcactttttaaaaatgcagatacatactgcagttccctgataaaagctgaaaagaaaatttgagtattttaagttaagatgtgataaaaaatgtgcatgtgccataatcaaatatatatgaaaaggcagtgttccttgtatttatttttttttctttttgtggcaaaagaaacttaaacatactgtttcagtcacattgcattgtagtgtatggcctgtttcttgtatctttaaagacgttgctcaataaaacaaatcttgcaactgttctatgttcactacaccttcagcattggataaaaatcattttctatataaatatcacattgaaatgaaaaaatgatttcttggcagtttaaaaaaaatattttatagtagtttagggagctgctttaagtagtttaaatctggattttcccagtagaattcttctcatctctggctaaacatgtcagaacaaacaaccaaccagtctgtaggcagaacaaagtcctatttcatccgctgggatacaatttcatcttccattcactttgtcattccacctctaagaagacagactatcattcctgaggcatgaaaattctcagggacaaagccatgcctcagtcacatgtgtgtgcagagagaaatgcacctgtctatctaagggtagatttttgatccctgaataattcattgactaaactgacctcttcctcctggctaaataaattaattttgctggcttctctctcagcggtttctattttgtaaattgctgcatgaccaaaatagccccactcaaaatcaattggattaattttaatggtttggttggatgaatattctggatgaatataaaatgtgctgcccttcacagatgacaccactcccctgtcaatcatagcacatgtgtactttttattgttacttaatagtgatggatttgcacttttctatcctcatactctttcctgttttcttctttgtacaattgcatgcaggagggctggatgccagggttaagagagaaattcatgacaaggaaggtaaaattggttcaaatgagcatgtgtcccacagccttagtctccttactcttaaatcagtggagctgtagcttagatgggtcgtttatatgtctggaaaagttgtcataacagtttagaagccaaggttgtggatttgatcttagaatgggcctgttaatcttatagaacccagaaattctgttcttttcatgtactgttgatgaggaatgaggaaagagaatttggagattcagcacaaaaccattgctacttctagaacaaaatctttagaatatgtcctaataacaaaggtcagtaatgtcatcttcatatatgaaggacacatgtgatacattgttcgtggaaatagaaatgtataattatgataaatgtttcacttgaatcttattgtaaggcttttcttgcttttattttttaaagtcagcaaaactcattttgtctgtcatctataagtcatagtgaggactacgagataagttgataagttcaattgatattaaggtgacatggcaatattaataactcaaatgtgaatgtttcaagtattgaattcttgtccctatgggacatttattaaataaaattaatgggactcttgcaaagtagccttaaaagtgttaatgagtctattaataaatatgaacacatactattattagaaccaactttactcatatctcaaatacagtacatttacattactgtagaggatgaagctctaatttctattacatgtaattttctttagaaagagaaccctgaaagctgccagtttttctattaactttgaattattgaaattgtatttatttaattttattgtttttacaaaattgcaccttgtgtccaaagggcgaagatatgacattgcataagggatttatgtttttcaaagagctaactgttttcatatccatactatatacacttgaagcaattggtaggaagagaacctattggaaaaatacgattttcaaaagtaagtattcctcgggatgtttttatataaattatgttttggaatagaacataaatgactttgagttaggataaggatgataggatgggtgctggagatgccctgccttgcttatttgtttctgtgggggatttaatactataaatgaaaatggcttctgctccattaaaaagtaaaaattgtcctccaaatataaaactccttaatagatatttttgaaattaaaatctttaaattttataaatcagctgttgccactacacaactatgatggcatgtgcttataacatttttataacattccgtctgtgtctattccctaaatatcatgagtttataataaggaaagtgataaaaatacagtaatgaaataaaaatctgaatgtttctaagaaaggttttggaaggaaaaatgacctgaaatcagtgcgtactgcaaagtacagccaataatttttgttctttgttttcacccccaccctcactggaattctcaccaaaaatagtttgatacttaaaaaacagaagtaaatacttttctcaatattgttttggctatgcaaatatttgttttgcttaatgtcctccatttacacttctcagcaaatgtagttgcaaacaaatgctttctttttatttttcccttggtttgaggtatgtaaatagccaaaaatgtacattgaatttcacattgtaaaagttttattttatcccttgtatgatattactcaaaaaatccctgtgtatatgaaagtgcataataaatatatttgctttacagagaagatcttgttttaattttgtccttgaaccagtagaacatgcatgatatgcatatagcataaacaactgttagttgttttaagttattatcttaaataaatcctgagcaaatgaatttggaaacattttgcaaagaagaaagtgaaatataacactgtccaaaggaaggtagaaaaacaaagatttactgtttatgtcttcctaagcctttttaaagacttaatgttcttttcccccccgtgactgattatatactatatcacaccatgtcaggttttgtgcctctgagaattgcagtaatccaataacttttgtatatgtgtgctccttgatcatcagaatattatggccatcttatggcggatattttgggagtttattgcaaacatggtcattcattttctaaataaaatttgtgtgtttcttcactcagtaaaaaag

SEQ ID NO: 31399 - DNA, 3675 bp, Homo sapiens
  misc_feature (61)..(61): n is a, c, g, or t
catatcttcacatcttatattatagtcgttcccccacatcctaacatcaacctttatgctnccgccagcacagcagggcatcaggaagtgttggagggatacccttcctcagagacagaattaagccttaaacaagctctgaagcttcagattgaaggttctgaccctagcttcaactataaaaaggaaacaccattataaaagtttcctattctgtgaaacagaagacattgtgatggagtggttcttcagctactggatggaaacatatgcctgttgatttgctgaaaaaacaaaaaaaatgaagaatgtgatctctgcagtacagttaccttaattactgtaatgtgcctaaatagtaaggctgccttctcaatgtaaccctctgtgcttaaaaaatttcattttgtgtgctttgtattcactacacaggaataagcactttttaaaaatgcagatacatactgcagttccctgataaaagctgaaaagaaaatttgagtattttaagttaagatgtgataaaaaatgtgcatgtgccataatcaaatatatatgaaaaggcagtgttccttgtatttatttttttttctttttgtggcaaaagaaacttaaacatactgtttcagtcacattgcattgtagtgtatggcctgtttcttgtatctttaaagacgttgctcaataaaacaaatcttgcaactgttctatgttcactacaccttcagcattggataaaaatcattttctatataaatatcacattgaaatgaaaaaatgatttcttggcagtttaaaaaaaatattttatagtagtttagggagctgctttaagtagtttaaatctggattttcccagtagaattcttctcatctctggctaaacatgtcagaacaaacaaccaaccagtctgtaggcagaacaaagtcctatttcatccgctgggatacaatttcatcttccattcactttgtcattccacctctaagaagacagactatcattcctgaggcatgaaaattctcagggacaaagccatgcctcagtcacatgtgtgtgcagagagaaatgcacctgtctatctaagggtagatttttgatccctgaataattcattgactaaactgacctcttcctcctggctaaataaattaattttgctggcttctctctcagcggtttctattttgtaaattgctgcatgaccaaaatagccccactcaaaatcaattggattaattttaatggtttggttggatgaatattctggatgaatataaaatgtgctgcccttcacagatgacaccactcccctgtcaatcatagcacatgtgtactttttattgttacttaatagtgatggatttgcacttttctatcctcatactctttcctgttttcttctttgtacaattgcatgcaggagggctggatgccagggttaagagagaaattcatgacaaggaaggtaaaattggttcaaatgagcatgtgtcccacagccttagtctccttactcttaaatcagtggagctgtagcttagatgggtcgtttatatgtctggaaaagttgtcataacagtttagaagccaaggttgtggatttgatcttagaatgggcctgttaatcttatagaacccagaaattctgttcttttcatgtactgttgatgaggaatgaggaaagagaatttggagattcagcacaaaaccattgctacttctagaacaaaatctttagaatatgtcctaataacaaaggtcagtaatgtcatcttcatatatgaaggacacatgtgatacattgttcgtggaaatagaaatgtataattatgataaatgtttcacttgaatcttattgtaaggcttttcttgcttttattttttaaagtcagcaaaactcattttgtctgtcatctataagtcatagtgaggactacgagataagttgataagttcaattgatattaaggtgacatggcaatattaataactcaaatgtgaatgtttcaagtattgaattcttgtccctatgggacatttattaaataaaattaatgggactcttgcaaagtagccttaaaagtgttaatgagtctattaataaatatgaacacatactattattagaaccaactttactcatatctcaaatacagtacatttacattactgtagaggatgaagctctaatttctattacatgtaattttctttagaaagagaaccctgaaagctgccagtttttctattaactttgaattattgaaattgtatttatttaattttattgtttttacaaaattgcaccttgtgtccaaagggcgaagatatgacattgcataagggatttatgtttttcaaagagctaactgttttcatatccatactatatacacttgaagcaattggtaggaagagaacctattggaaaaatacgattttcaaaagtaagtattcctcgggatgtttttatataaattatgttttggaatagaacataaatgactttgagttaggataaggatgataggatgggtgctggagatgccctgccttgcttatttgtttctgtgggggatttaatactataaatgaaaatggcttctgctccattaaaaagtaaaaattgtcctccaaatataaaactccttaatagatatttttgaaattaaaatctttaaattttataaatcagctgttgccactacacaactatgatggcatgtgcttataacatttttataacattccgtctgtgtctattccctaaatatcatgagtttataataaggaaagtgataaaaatacagtaatgaaataaaaatctgaatgtttctaagaaaggttttggaaggaaaaatgacctgaaatcagtgcgtactgcaaagtacagccaataatttttgttctttgttttcacccccaccctcactggaattctcaccaaaaatagtttgatacttaaaaaacagaagtaaatacttttctcaatattgttttggctatgcaaatatttgttttgcttaatgtcctccatttacacttctcagcaaatgtagttgcaaacaaatgctttctttttatttttcccttggtttgaggtatgtaaatagccaaaaatgtacattgaatttcacattgtaaaagttttattttatcccttgtatgatattactcaaaaaatccctgtgtatatgaaagtgcataataaatatatttgctttacagagaagatcttgttttaattttgtccttgaaccagtagaacatgcatgatatgcatatagcataaacaactgttagttgttttaagttattatcttaaataaatcctgagcaaatgaatttggaaacattttgcaaagaagaaagtgaaatataacactgtccaaaggaaggtagaaaaacaaagatttactgtttatgtcttcctaagcctttttaaagacttaatgttcttttcccccccgtgactgattatatactatatcacaccatgtcaggttttgtgcctctgagaattgcagtaatccaataacttttgtatatgtgtgctccttgatcatcagaatattatggccatcttatggcggatattttgggagtttattgcaaacatggtcattcattttctaaataaaatttgtgtgtttcttcactcagtaaaaaag

SEQ ID NO: 31400 - DNA, 6869 bp, Homo sapiens
gacaacacctcacaaaagaaactgcagagatgttaaatcaactgcacattaaaagcagtggatgctttctttacctagaacgagttttagatggagttgtagaaaattttattatgttaagagaaattcgtgacatcccaggaactctaaatggtttatatctctggctgtgccaaagactttttgtaagaaaacaatttgcaaaggttcagcctattttgaatgtgattcttgcagcctgccgacctttgaccataacggaattatatcacgcagtatggaccaaaaacatgtcgttaactttggaagattttcaacgcaagttagatatcctctccaaacttcttgttgatggactaggaaatacaaaaatactgtttcattatagttttgccgagtggcttctggatgtgaaacactgtactcagaagtatttatgtaatgcagcagaaggacacagaatgttggctatgagttatacctgtcaagccaagaatttaacaccattggaagcacaagaatttgcattgcacttaattaactcaaacttacaattagagacagcggagttagctctgtggatgatatggaatggtacacctgtcagagattccctttctactttgatacccaaggaacaagaagtgctacagctgttggttaaagctggggctcatgtcaacagtgaagacgatcgcacatcatgcatagttcgacaagccttagaaagagaggatccattcggacattattagataatggagcttcagtaaatcagtgtgattcaaatgggagaacattattggctaatgctgcatatagtggcagtcttgatgtagtcaatttacttgtctctaggggagcagatttagagatagaagatgctcatggacatacaccactcactctagcggctagacagggacataccaaggtggttaattgtttgattgggtgtggagcaaatattaatcatactgatcaagatggttggacagcattaagatctgctgcttggggtggccatactgaggtagtttctgcactactttatgctggcgtaaaagtggattgtgcagatgctgatagccgaacagctttgagagcagcagcatggggaggacacgaggatattgtactgaatttgctacaacatggcgctgaagtgaacaaagctgataatgaaggtagaactgctttgatagcagcagcatacatgggacatagagagattgtggaacacctactggaccatggagcagaagtaaatcatgaggatgttgatggcaggactgcactctctgtagctgcactttgtgtgcctgcaagtaaagggcacgcatcagttgttagccttttaattgatcgaggtgctgaagtagatcattgtgataaagatggcatgactccactgctggtagctgcctatgaaggacatgttgatgtggttgacttgcttctagaagggggagcagatgtagatcacacagataacaatggccgtacacccctcttagcagcagcgtctatgggtcatgcatcagttgtaaatacacttttgttttggggtgcagctgtggatagtattgatagtgaaggtaggacagtcctcagtatagcttcagcacaaggaaatgttgaggtggtacgtactctactggatagagggttagatgaaaatcacagagatgatgctggatggacacctttgcacatggcagcttttgaagggcacagattgatatgtgaagcacttattgaacaaggtgctagaacaaatgagattgacaatgatggacgaatccctttcatattagcttcacaagagggtcattatgattgtgttcaaatattactggaaaacaaatccaacattgatcaaagaggttatgatggaagaaatgcactgcgggttgctgcattagaagggcacagggacattgttgaattgctttttagccatggtgctgatgttaactgcaaagatgctgatggtcggcctacactttatatcttggccttagaaaatcagcttacaatggccgaatattttttagaaaatggtgcaaacgtagaagcaagtgatgctgaaggaaggacagcacttcatgtgtcttgttggcaaggccatatggaaatggtgcaggtcctgatagcataccatgctgacgtcaatgctgcagacaatgaaaagcgctctgctttgcagtctgcagcctggcagggccatgtaaaagtggttcagcttctgattgagcatggtgctgtagttgaccatacatgtaaccaaggtgcaactgcactctgtattgcagcccaggaagggcacattgatgttgttcaggtcttattagagcatggtgctgatccaaaccatgctgatcaatttggacgcactgctatgcgtgttgcagccaaaaatggacattctcagataattaaattattagaaaaatatggtgcatctagtttgaatggctgttccccatctcctgttcacacaatggagcaaaaacctctacagtcattgtcttcaaaagtgcagtcattaacaattaaatcaaatagctctggtagtactggtggaggggatatgcagccttcgttacgtggtttacctaatgggcctactcatgcttttagttctccttcagaatctccagattctacagttgaccggcagaagtcatcactgtcaaataattccctgaaaagctcaaaaaattcatctttgagaactacttcatctacagcaacggctcaaacagtgccaattgatagctttcataacttgtcatttacagaacaaattcagcagcattcattgccacgcagtagaagtcgacagtcaattgtttccccatcttccacaacacagtccttaggacagagtcataattcaccaagtagtgaatttgagtggagtcaagtaaagcccagtttgaagtcaactaaagcaagtaaaggggggaaatcagaaaattctgccaagtctggatcagctgggaaaaaagcgaaacaaagtaattcttcacagccaaaggttttagaatatgaaatgactcagtttgatagaagaggacctatagccaaatccgggactgctgcaccacctaaacaaatgccagcagaatctcaatgcaaaattatgataccttcagctcagcaggaaattggtcgatctcaacagcagtttcttattcaccaacaaagtggggaacagaagaagagaaatggaataatgacaaatccaaattatcatcttcagagcaaccaggtttttcttggtagggtttcagtcccacgaacaatgcaagatagagggcatcaggaagtgttggagggatacccttcctcagagacagaattaagccttaaacaagctctgaagcttcagattgaaggttctgaccctagcttcaactataaaaaggaaacaccattataaaagtttcctattctgtgaaacagaagacattgtgatggagtggttcttcagctactggatggaaacatatgcctgttgatttgctgaaaaaacaaaaaaaatgaagaatgtgatctctgcagtacagttaccttaattactgtaatgtgcctaaatagtaaggctgccttctcaatgtaaccctctgtgcttaaaaaatttcattttgtgtgctttgtattcactacacaggaataagcactttttaaaaatgcagatacatactgcagttccctgataaaagctgaaaagaaaatttgagtattttaagttaagatgtgataaaaaatgtgcatgtgccataatcaaatatatatgaaaaggcagtgttccttgtatttatttttttttctttttgtggcaaaagaaacttaaacatactgtttcagtcacattgcattgtagtgtatggcctgtttcttgtatctttaaagacgttgctcaataaaacaaatcttgcaactgttctatgttcactacaccttcagcattggataaaaatcattttctatataaatatcacattgaaatgaaaaaatgatttcttggcagtttaaaaaaaatattttatagtagtttagggagctgctttaagtagtttaaatctggattttcccagtagaattcttctcatctctggctaaacatgtcagaacaaacaaccaaccagtctgtaggcagaacaaagtcctatttcatccgctgggatacaatttcatcttccattcactttgtcattccacctctaagaagacagactatcattcctgaggcatgaaaattctcagggacaaagccatgcctcagtcacatgtgtgtgcagagagaaatgcacctgtctatctaagggtagatttttgatccctgaataattcattgactaaactgacctcttcctcctggctaaataaattaattttgctggcttctctctcagcggtttctattttgtaaattgctgcatgaccaaaatagccccactcaaaatcaattggattaattttaatggtttggttggatgaatattctggatgaatataaaatgtgctgcccttcacagatgacaccactcccctgtcaatcatagcacatgtgtactttttattgttacttaatagtgatggatttgcacttttctatcctcatactctttcctgttttcttctttgtacaattgcatgcaggagggctggatgccagggttaagagagaaattcatgacaaggaaggtaaaattggttcaaatgagcatgtgtcccacagccttagtctccttactcttaaatcagtggagctgtagcttagatgggtcgtttatatgtaatgggcctgttaatcttatagaacccagaaattctgttcttttcatgtactgttgatgaggaatgaggaaagagaatttggagattcagcacaaaaccattgctacttctagaacaaaatctttagaatatgtcctaataacaaaggtcagtaatgtcatcttcatatatgaaggacacatgtgatacattgttcgtggaaatagaaatgtataattatgataaatgtttcacttgaatcttattgtaaggcttttcttgcttttattttttaaagtcagcaaaactcattttgtctgtcatctataagtcatagtgaggactacgagataagttgataagttcaattgatattaaggtgacatggcaatattaataactcaaatgtgaatgtttcaagtattgaattcttgtccctatgggacatttattaaataaaattaatgggactcttgcaaagtagccttaaaagtgttaatgagtctattaataaatatgaacacatactattattagaaccaactttactcatatctcaaatacagtacatttacattactgtagaggatgaagctctaatttctattacatgtaattttctttagaaagagaaccctgaaagctgccagtttttctattaactttgaattattgaaattgtatttatttaattttattgtttttacaaaattgcaccttgtgtccaaagggcgaagatatgacattgcataagggatttatgtttttcaaagagctaactgttttcatatccatactatatacacttgaagcaattggtaggaagagaacctattggaaaaatacgattttcaaaagtaagtattcctcgggatgtttttatataaattatgttttggaatagaacataaatgactttgagttaggataaggatgataggatgggtgctggagatgccctgccttgcttatttgtttctgtgggggatttaatactataaatgaaaatggcttctgctccattaaaaagtaaaaattgtcctccaaatataaaactccttaatagatatttttgaaattaaaatctttaaattttataaatcagctgttgccactacacaactatgatggcatgtgcttataacatttttataacattccgtctgtgtctattccctaaatatcatgagtttataataaggaaagtgataaaaatacagtaatgaaataaaaatctgaatgtttctaagaaaggttttggaaggaaaaatgacctgaaatcagtgcgtactgcaaagtacagccaataatttttgttctttgttttcacccccaccctcactggaattctcaccaaaaatagtttgatacttaaaaaacagaagtaaatacttttctcaatattgttttggctatgcaaatatttgttttgcttaatgtcctccatttacacttctcagcaaatgtagttgcaaacaaatgctttctttttatttttcccttggtttgaggtatgtaaatagccaaaaatgtacattgaatttcacattgtaaaagttttattttatcccttgtatgatattactcaaaaaatccctgtgtatatgaaagtgcataataaatatatttgctttacagagaagatcttgttttaattttgtccttgaaccagtagaacatgcatgatatgcatatagcataaacaactgttagttgttttaagttattatcttaaataaatcctgagcaaatgaatttggaaacattttgcaaagaagaaagtgaaatataacactgtccaaaggaaggtagaaaaacaaagatttactgtttatgtcttcctaagcctttttaaagacttaatgttcttttcccccccgtgactgattatatactatatcacaccatgtcaggttttgtgcctctgagaattgcagtaatccaataacttttgtatatgtgtgctccttgatcatcagaatattatggccatcttatggcggatattttgggagtttattgcaaacatggtcattcattttctaaataaaatttgtgtgtttcttcactcagtaaaaaag

SEQ ID NO: 31401 - DNA, 3952 bp, Homo sapiens
gacaacacctcacaaaagaaactgcagagatgttaaatcaactgcacattaaaagcagtggatgctttctttacctagaacgagttttagatggagttgtagaaaattttattatgttaagagaaattcgtgacatcccaggaactctaaatggtttatatctctggctgtgccaaagactttttgtaagaaaacaatttgcaaaggttcagcctattttgaatgtgattcttgcagcctgccgacctttgaccataacggaattatatcacgcagtatggaccaaaaacatgtcgttaactttggaagattttcaacgcaagttagatatcctctccaaacttcttgttgatggactaggaaatacaaaaatactgtttcattatagttttgccgagtggcttctggatgtgaaacactgtactcagaagtatttatgtaatgcagcagaaggacacagaatgttggctatgagttatacctgtcaagccaagaatttaacaccattggaagcacaagaatttgcattgcacttaattaactcaaacttacaattagagacagcggagttagctctgtggatgatatggaatggtacacctgtcagagattccctttctactttgatacccaaggaacaagaagtgctacagctgttggttaaagctggggctcatgtcaacagtgaagacgatcgcacatcatgcatagttcgacaagccttagaaagagaggatccattcggacattattagataatggagcttcagtaaatcagtgtgattcaaatgggagaacattattggctaatgctgcatatagtggcagtcttgatgtagtcaatttacttgtctctaggggagcagatttagagatagaagatgctcatggacatacaccactcactctagcggctagacagggacataccaaggtggttaattgtttgattgggtgtggagcaaatattaatcatactgatcaagatggttggacagcattaagatctgctgcttggggtggccatactgaggtagtttctgcactactttatgctggcgtaaaagtggattgtgcagatgctgatagccgaacagctttgagagcagcagcatggggaggacacgaggatattgtactgaatttgctacaacatggcgctgaagtgaacaaagctgataatgaaggtagaactgctttgatagcagcagcatacatgggacatagagagattgtggaacacctactggaccatggagcagaagtaaatcatgaggatgttgatggcaggactgcactctctgtagctgcactttgtgtgcctgcaagtaaagggcacgcatcagttgttagccttttaattgatcgaggtgctgaagtagatcattgtgataaagatggcatgactccactgctggtagctgcctatgaaggacatgttgatgtggttgacttgcttctagaagggggagcagatgtagatcacacagataacaatggccgtacacccctcttagcagcagcgtctatgggtcatgcatcagttgtaaatacacttttgttttggggtgcagctgtggatagtattgatagtgaaggtaggacagtcctcagtatagcttcagcacaaggaaatgttgaggtggtacgtactctactggatagagggttagatgaaaatcacagagatgatgctggatggacacctttgcacatggcagcttttgaagggcacagattgatatgtgaagcacttattgaacaaggtgctagaacaaatgagattgacaatgatggacgaatccctttcatattagcttcacaagagggtcattatgattgtgttcaaatattactggaaaacaaatccaacattgatcaaagaggttatgatggaagaaatgcactgcgggttgctgcattagaagggcacagggacattgttgaattgctttttagccatggtgctgatgttaactgcaaagatgctgatggtcggcctacactttatatcttggccttagaaaatcagcttacaatggccgaatattttttagaaaatggtgcaaacgtagaagcaagtgatgctgaaggaaggacagcacttcatgtgtcttgttggcaaggccatatggaaatggtgcaggtcctgatagcataccatgctgacgtcaatgctgcagacaatgaaaagcgctctgctttgcagtctgcagcctggcagggccatgtaaaagtggttcagcttctgattgagcatggtgctgtagttgaccatacatgtaaccaaggtgcaactgcactctgtattgcagcccaggaagggcacattgatgttgttcaggtcttattagagcatggtgctgatccaaaccatgctgatcaatttggacgcactgctatgcgtgttgcagccaaaaatggacattctcagataattaaattattagaaaaatatggtgcatctagtttgaatggctgttccccatctcctgttcacacaatggagcaaaaacctctacagtcattgtcttcaaaagtgcagtcattaacaattaaatcaaatagctctggtagtactggtggaggggatatgcagccttcgttacgtggtttacctaatgggcctactcatgcttttagttctccttcagaatctccagattctacagttgaccggcagaagtcatcactgtcaaataattccctgaaaagctcaaaaaattcatctttgagaactacttcatctacagcaacggctcaaacagtgccaattgatagctttcataacttgtcatttacagaacaaattcagcagcattcattgccacgcagtagaagtcgacagtcaattgtttccccatcttccacaacacagtccttaggacagagtcataattcaccaagtagtgaatttgagtggagtcaagtaaagcccagtttgaagtcaactaaagcaagtaaaggggggaaatcagaaaattctgccaagtctggatcagctgggaaaaaagcgaaacaaagtaattcttcacagccaaaggttttagaatatgaaatgactcagtttgatagaagaggacctatagccaaatccgggactgctgcaccacctaaacaaatgccagcagaatctcaatgcaaaattatgataccttcagctcagcaggaaattggtcgatctcaacagcagtttcttattcaccaacaaagtggggaacagaagaagagaaatggaataatgacaaatccaaattatcatcttcagagcaaccaggtttttcttggtagggtttcagtcccacgaacaatgcaagatagagggcatcaggaagtgttggagggatacccttcctcagagacagaattaagccttaaacaagctctgaagcttcagattgaaggttctgaccctagcttcaactataaaaaggaaacaccattataaaagtttcctattctgtgaaacagaagacattgtgatggagtggttcttcagctactggatggaaacatatgcctgttgatttgctgaaaaaacaaaaaaaatgaagaatgtgatctctgcagtacagttaccttaattactgtaatgtgcctaaatagtaaggctgccttctcaatgtaaccctctgtgcttaaaaaatttcattttgtgtgctttgtattcactacacaggaataagcactttttaaaaatgcagatacatactgcagttccctgataaaagctgaaaagaaaatttgagtattttaagttaagatgtgataaaaaatgtgcatgtgccataatcaaatatatatgaaaaggcagtgttccttgtatttatttttttttctttttgtggcaaaagaaacttaaacatactgtttcagtcacattgcattgtagtgtatggcctgtttcttgtatctttaaagacgttgctcaataaaacaaatcttgcaactg

SEQ ID NO: 31402 - DNA, 4038 bp, Homo sapiens
taaggcgtaccgcacactgtccagtgctgaatgcagccctatgattcacagcccagtttgaagtcaactaaagcaagtaaaggggggaaatcagaaaattctgccaagtctggatcagctgggaaaaaagcgaaacaaagtaattcttcacagccaaaggttttagaatatgaaatgactcagtttgatagaagaggacctatagccaaatccgggactgctgcaccacctaaacaaatgccagcagaatctcaatgcaaaattatgataccttcagctcagcaggaaattggtcgatctcaacagcagtttcttattcaccaacaaagtggggaacagaagaagagaaatggaataatgacaaatccaaattatcatcttcagagcaaccaggtttttcttggtagggtttcagtcccacgaacaatgcaagatagagggcatcaggaagtgttggagggatacccttcctcagagacagaattaagccttaaacaagctctgaagcttcagattgaaggttctgaccctagcttcaactataaaaaggaaacaccattataaaagtttcctattctgtgaaacagaagacattgtgatggagtggttcttcagctactggatggaaacatatgcctgttgatttgctgaaaaaacaaaaaaaatgaagaatgtgatctctgcagtacagttaccttaattactgtaatgtgcctaaatagtaaggctgccttctcaatgtaaccctctgtgcttaaaaaatttcattttgtgtgctttgtattcactacacaggaataagcactttttaaaaatgcagatacatactgcagttccctgataaaagctgaaaagaaaatttgagtattttaagttaagatgtgataaaaaatgtgcatgtgccataatcaaatatatatgaaaaggcagtgttccttgtatttatttttttttctttttgtggcaaaagaaacttaaacatactgtttcagtcacattgcattgtagtgtatggcctgtttcttgtatctttaaagacgttgctcaataaaacaaatcttgcaactgttctatgttcactacaccttcagcattggataaaaatcattttctatataaatatcacattgaaatgaaaaaatgatttcttggcagtttaaaaaaaatattttatagtagtttagggagctgctttaagtagtttaaatctggattttcccagtagaattcttctcatctctggctaaacatgtcagaacaaacaaccaaccagtctgtaggcagaacaaagtcctatttcatccgctgggatacaatttcatcttccattcactttgtcattccacctctaagaagacagactatcattcctgaggcatgaaaattctcagggacaaagccatgcctcagtcacatgtgtgtgcagagagaaatgcacctgtctatctaagggtagatttttgatccctgaataattcattgactaaactgacctcttcctcctggctaaataaattaattttgctggcttctctctcagcggtttctattttgtaaattgctgcatgaccaaaatagccccactcaaaatcaattggattaattttaatggtttggttggatgaatattctggatgaatataaaatgtgctgcccttcacagatgacaccactcccctgtcaatcatagcacatgtgtactttttattgttacttaatagtgatggatttgcacttttctatcctcatactctttcctgttttcttctttgtacaattgcatgcaggagggctggatgccagggttaagagagaaattcatgacaaggaaggtaaaattggttcaaatgagcatgtgtcccacagccttagtctccttactcttaaatcagtggagctgtagcttagatgggtcgtttatatgtctggaaaagttgtcataacagtttagaagccaaggttgtggatttgatcttagaatgggcctgttaatcttatagaacccagaaattctgttcttttcatgtactgttgatgaggaatgaggaaagagaatttggagattcagcacaaaaccattgctacttctagaacaaaatctttagaatatgtcctaataacaaaggtcagtaatgtcatcttcatatatgaaggacacatgtgatacattgttcgtggaaatagaaatgtataattatgataaatgtttcacttgaatcttattgtaaggcttttcttgcttttattttttaaagtcagcaaaactcattttgtctgtcatctataagtcatagtgaggactacgagataagttgataagttcaattgatattaaggtgacatggcaatattaataactcaaatgtgaatgtttcaagtattgaattcttgtccctatgggacatttattaaataaaattaatgggactcttgcaaagtagccttaaaagtgttaatgagtctattaataaatatgaacacatactattattagaaccaactttactcatatctcaaatacagtacatttacattactgtagaggatgaagctctaatttctattacatgtaattttctttagaaagagaaccctgaaagctgccagtttttctattaactttgaattattgaaattgtatttatttaattttattgtttttacaaaattgcaccttgtgtccaaagggcgaagatatgacattgcataagggatttatgtttttcaaagagctaactgttttcatatccatactatatacacttgaagcaattggtaggaagagaacctattggaaaaatacgattttcaaaagtaagtattcctcgggatgtttttatataaattatgttttggaatagaacataaatgactttgagttaggataaggatgataggatgggtgctggagatgccctgccttgcttatttgtttctgtgggggatttaatactataaatgaaaatggcttctgctccattaaaaagtaaaaattgtcctccaaatataaaactccttaatagatatttttgaaattaaaatctttaaattttataaatcagctgttgccactacacaactatgatggcatgtgcttataacatttttataacattccgtctgtgtctattccctaaatatcatgagtttataataaggaaagtgataaaaatacagtaatgaaataaaaatctgaatgtttctaagaaaggttttggaaggaaaaatgacctgaaatcagtgcgtactgcaaagtacagccaataatttttgttctttgttttcacccccaccctcactggaattctcaccaaaaatagtttgatacttaaaaaacagaagtaaatacttttctcaatattgttttggctatgcaaatatttgttttgcttaatgtcctccatttacacttctcagcaaatgtagttgcaaacaaatgctttctttttatttttcccttggtttgaggtatgtaaatagccaaaaatgtacattgaatttcacattgtaaaagttttattttatcccttgtatgatattactcaaaaaatccctgtgtatatgaaagtgcataataaatatatttgctttacagagaagatcttgttttaattttgtccttgaaccagtagaacatgcatgatatgcatatagcataaacaactgttagttgttttaagttattatcttaaataaatcctgagcaaatgaatttggaaacattttgcaaagaagaaagtgaaatataacactgtccaaaggaaggtagaaaaacaaagatttactgtttatgtcttcctaagcctttttaaagacttaatgttcttttcccccccgtgactgattatatactatatcacaccatgtcaggttttgtgcctctgagaattgcagtaatccaataacttttgtatatgtgtgctccttgatcatcagaatattatggccatcttatggcggatattttgggagtttattgcaaacatggtcattcattttctaaataaaatttgtgtgtttcttcactcagtaaaaaag

SEQ ID NO: 31403 - DNA, 521 bp, Homo sapiens
gagtggaaggggtgctgccatgcaggtgcccaggagacagggtcccctttaccaatcatggtgcacttctcaggctcttgggagatggtgtccagggggaaaccaagctcctagcagctggaggcatgagggagagggcgggcccctgggctggggagcaaagcaggccccaggctgcaccaggacaccccggccagccaatgcatgtgggtatgcctgaataccccctccagacagcgtgtgcgtggaccagacacacaagggtatgtatgtgtaccgctacccccccaaccccatgctccaagaatgaatcaggggcagcttccgccgggggcgccaccaccacctccgcccccaagcctggtccccaaatactttccaccctcacagagcagctgggatcggaaaataccaagggctgcaggccccgccctgcccgccgcgccacccgccctcccagcctgtcactaacgctttgcctaatgggcccagactctcagcagaagctccgtgggctgggc

SEQ ID NO: 31404 - DNA, 290 bp, Homo sapiens
gagtggaaggggtgctgccatgcaggtgcccaggagacagggtcccctttaccaatcatggtgcacttctcaggctcttgggagatggtgtccagggggaaaccaagctcctagcagctggaggcatgagggagagggcgggcccctgggctggggagcaaagcaggccccaggctgcaccaggacaccccggccagccaatgcatgtgggtatgcctgaataccccctccccgggtagcggtacacatacatacccttgtgtgtctggtccacgcacacgctgtctgga

SEQ ID NO: 31405 - DNA, 961 bp, Homo sapiens
agctgagtgactctcttattaccaccgctcaggaagatcatgcggtttctgggaagcattggagaaggaaaaggctgaagaaaggaagaccggaaaagaaatacaagtccttccgccttggcaaagatgatagtaccgttcccttcagtgttccggttctgctctattggataagttccggtttgactatgactacgtgaaaatgtggaaccagaccttcaccccacattccagctccagctctaccacagaggaagtgcaatatcaccttagttattcaacacattatgctcctcgtgatacaaccagagttcacatcagcaatcttggcagctctcaccacgctgctgactcacgactctctcatgtcccaatttcctgtccattgttctttcctctacttggcctgatttctaaaggcctctcttggttgcattaagcgggattcctgagggattcccttggcagttaccttgggggagctcttaggtttggggctgatccatgtcctctaaatgtaggacttcaaagctcccaaagataggcaggcccagtgggaagctgggaaatgctctctgacccctctgggagggctggcagtcagagggccttttggaaagagtcagacctgatccataagtccctggaaaacaccctgcccagggagcaaatgccactgtggccttgactgaggcttcagaagagtttgggagctgcaattcatccacacacgcattcattttcaagtagtggtttgcagttcaggctttggagccacataagcctggcttcaaagccactttccagctttgtaggaagtctctacatttttaaacctccatttttttttcctgtaaaactggggtcttcatggtacttaacttcatcgtgatgttgagagaatgaaaagaaaaaggataaataaatggcttagcctcgtgccttggcacatattgtgatt

SEQ ID NO: 31406 - DNA, 920 bp, Homo sapiens
acgacgcggacgacgcgaagaagggaggtagcagggcgggcagatttcttggaaaagaaatacaagtccttccgccttggcaaagatgatagtaccgttcccttcagtgttccggttctgctctattggataagttccggtttgactatgactacgtgaaaatgtggaaccagaccttcaccccacattccagctccagctctaccacagaggaagtgcaatatcaccttagttattcaacacattatgctcctcgtgatacaaccagagttcacatcagcaatcttggcagctctcaccacgctgctgactcacgactctctcatgtcccaatttcctgtccattgttctttcctctacttggcctgatttctaaaggcctctcttggttgcattaagcgggattcctgagggattcccttggcagttaccttgggggagctcttaggtttggggctgatccatgtcctctaaatgtaggacttcaaagctcccaaagataggcaggcccagtgggaagctgggaaatgctctctgacccctctgggagggctggcagtcagagggccttttggaaagagtcagacctgatccataagtccctggaaaacaccctgcccagggagcaaatgccactgtggccttgactgaggcttcagaagagtttgggagctgcaattcatccacacacgcattcattttcaagtagtggtttgcagttcaggctttggagccacataagcctggcttcaaagccactttccagctttgtaggaagtctctacatttttaaacctccatttttttttcctgtaaaactggggtcttcatggtacttaacttcatcgtgatgttgagagaatgaaaagaaaaaggataaataaatggcttagcctcgtgccttggcacatattgtgatt

SEQ ID NO: 31407 - DNA, 1001 bp, Homo sapiens
gccatcttcaccccaagcccactggtcctcgagatacgacatccagacccagtgcagctggacctggcccaggaagatcatgcggtttctgggaagcattggagaaggaaaaggctgaagaaaggaagaccggaaaagaaatacaagtccttccgccttggcaaagatgatagtaccgttcccttcagtgttccggttctgctctattggataagttccggtttgactatgactacgtgaaaatgtggaaccagaccttcaccccacattccagctccagctctaccacagaggaagtgcaatatcaccttagttattcaacacattatgctcctcgtgatacaaccagagttcacatcagcaatcttggcagctctcaccacgctgctgactcacgactctctcatgtcccaatttcctgtccattgttctttcctctacttggcctgatttctaaaggcctctcttggttgcattaagcgggattcctgagggattcccttggcagttaccttgggggagctcttaggtttggggctgatccatgtcctctaaatgtaggacttcaaagctcccaaagataggcaggcccagtgggaagctgggaaatgctctctgacccctctgggagggctggcagtcagagggccttttggaaagagtcagacctgatccataagtccctggaaaacaccctgcccagggagcaaatgccactgtggccttgactgaggcttcagaagagtttgggagctgcaattcatccacacacgcattcattttcaagtagtggtttgcagttcaggctttggagccacataagcctggcttcaaagccactttccagctttgtaggaagtctctacatttttaaacctccatttttttttcctgtaaaactggggtcttcatggtacttaacttcatcgtgatgttgagagaatgaaaagaaaaaggataaataaatggcttagcctcgtgccttggcacatattgtgatt

SEQ ID NO: 31408 - DNA, 406 bp, Homo sapiens
ggagatatttccaacacaccctctcttctatgccctttccctaggaaagggcaggatttcacattaaacttagtgaatatttaagtcagggtaagtcttatcctaactatagaatgaaaccatttttgtctcttagtgaatggattttacacctcagtgaacaggtaagagggtttatctttgtgaagtagaagtctttctcatccccttaagaggctacccacttctgcatataaagttaaactatatgagtttgtctccaaaatttataataactggattacctccttgatcccttcaaaatgaagtgtctgataaaaaaagagaattaaatttaaatgtgtcttatgaaagaacattatttaatcaaaagaaagataattattcttctattcttactctcctt

SEQ ID NO: 31409 - DNA, 396 bp, Homo sapiens
aggatcacagctcgctgttatctcagcttcctaggctcaagcaagattcccgcctcagcctcctgaataactgggaccacaggcatgcaccaccacacccaactcagtttttgagattttttatggagatggggtctcactatgttgtcaagtctagtcttgaactcctgggctcaagtgatccacctcagcttcccaaagtgccggcattacaggcgcgaagcagcacacccagcctctcttttttattttatagcatttatcactttcaaatatacttcgtgatttacttgaatatgatttacttatttaccatgttattattttcttcctctagtgcccagaacactatctggcacattgtagataatctatatatgtttgttaagtgaatga

SEQ ID NO: 31410 - DNA, 481 bp, Homo sapiens
agccacaattccctattctttattgggggcattcagtaaacaccactgaataaaattaagaaaatggaaataggcaaacatgaatgcaatatcagtaatatgcagagtagaatttagcacacattttatgatatgggattgagagggtttgttttactgacagtgattacaatccttaacaaaaatctggctgtatgcactgacacatctattacgcaataattgtcagcaattgccaaacaagttgagagaaacaattttaacacctctctcggtatgatacattacataaataaaaatgcctgatggaaagattactgaataagataattactgacttttatcttaaaaatttatatctgaggacatactccagacagaatatttattttaattccaagtacctacaccaaatacccatgcatggtttagaaaactgaagcctactttagcccacagaaagaagctcggtgtgttctac

SEQ ID NO: 31411 - DNA, 343 bp, Homo sapiens
tgagactgatcttgctctgttgccaggctgcagtgtggtggcacgacctcagctcactgcaacctccccctcctgggctcaaatgattctcctgcctcagcatcctgagtaactgggattacaggcacatgccaccacgcccagctaatttttgtatttttagtagagacggggtttcaccatgttggccaggatggtctcgatctcttgacctcgtgatccgcgcgggtcggcctcccaaagtgttgggattacaggcgtgagacatcgtattcccaaaaatattctttctttatccaatattttctttgttactttttcttatttgcatgtattattttcc

SEQ ID NO: 31412 - DNA, 555 bp, Homo sapiens
ttactattgcttttcttcataattttaccaaatttgcatgtttaaacaatgtatttcatgattttgaactgtttatatgtggaatgataatgaatgcattcttctgttacttttattgctcaatattcttcaaattgatctgtgttgcaaataggtacatttcacctgtgtgctattacactgggtaaattaccgctctactccttattctcattgcagttattttctgaattggtgtaggggtgtttgttctttttctgttatagagggtggctatccttgtttcctgatttgcatgtactgtaagaggttctctagggtatatacttggggtggaattcttaaatcaagggtacgcgtatttcattttgagtagataatgccaaattgttttctaaagtgttccttcttttcatagtcccattggcaaggataaagatcccctttgtggccaccacgcccggccctcggtgttattctggccctgattctattttagtaaatagattttactagcagatagggatgggttgggaagaggaaccttaattatag

SEQ ID NO: 31413 - DNA, 332 bp, Homo sapiens
ctttttattagactacatggtgggtgatcactatgtattcataatttgaactttgaaattttattactgtctacttgaaaccaatcacttaatttaattattgcttataagtttgtttcacctaccatggttcctttgtaatgcaaaaccacaaaccaaagtccagtagtttccccttatccatgggagatactttctaagaccccccagtggatgcctgaaactcagatagtactgaaccctatatatactatcttttccttataaatatgtacatatgataaaatttaatttgtcaattagacacagcaagaaattaacaacaaaaataa

SEQ ID NO: 31414 - DNA, 579 bp, Homo sapiens
gctaaaaccttgctgaagatgaatgtataatccaagattagtaaacatgacaattcatcataaatgagaatcagcagacagtaaaaaagcaggcctcatcccccaaaattttagaaaatcagacaactccagtaattctaactccttacttccagtaagtcaagcagcatacaccacctcagagtcttgtacctgtaattgccctttgtctgtaatttttttccctcacaaatagccacttggcctattctctcccattcaccaggtttcatactaacaaggccttccctaccccctctataagacaccatactgccccaacatattcctggtatacatattccttcataaatatctacatagcactttggacacaccaacttactgggtagtgcttactatgcgtctttcccccaccagaaatgtagctccatgaggcggtgactttgtttttttgttttttcttttttgagacgaagtctcactctgtcgcccaggctgcagtgcagttgcaaaatctcagctcactgcaacctccgcctggtgacaagagtgagactctgtctcaaaaataattaa

SEQ ID NO: 31415 - DNA, 549 bp, Homo sapiens
ggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagg

SEQ ID NO: 31416 - DNA, 292 bp, Homo sapiens
ctcagaaattccaaggaaagtgcaaagaataaattcatcaggaagccaagcagagcacgtaaaatgaaatcacattagcaacgatggcaacaagaaaaattgatttcagaagtgtccacatactcatttcaaaaaaatataaagctgaaaattgtctcctgggcaatgaacatctggaagtgatcaagatgggacaaggtagttgcccatggagcaccttgcagagtgcttagtacatggtgtgttggggaagggggcttgaaacaaagtatggtccttgaaggtgtcccat

SEQ ID NO: 31417 - DNA, 798 bp, Homo sapiens
agggataacatgaacaatttgcccttctttaaagattaaatgccatgttttgtcagttagatgcatatttttcatatttaccacatctgaaattggtattttgtaggtttttttcttttgctcgcttggcgggacataatatagatagctatataaaaaacggtcatgacaaccatggtggtgcacccctgtaatcatagctacgcaagaggctgaggtggaggatcagttgagcccaggagtttgaggctacagtgaattatgattgtgccagttcactccagtctgggtgacagagtgagagcccatctcttaaaaaaagaaaaaaaaaaatagaaatgaatgatatcagtggtgtattctactttatggagaggtatccaaattctgtgaaatactgaagtaagtccccagctttatacttgatttaaaaatacccatgaatatgattattaattaaatattcattcttccccattgtctctccaaatgtctccttcctttcatttttctctcaatcctaaatactgaaaaatggggaatttcaatgtagtatcagtggagcccagttgggcagttggaactgaggcaaagaactgaggtgtctgtattagaagggaaagtaaggagggtaacattagcaatttatggtttactaattagactgtgggcctaatgtgaaggtctgcttatcagttttaatgttttgtttataggggaaaatttccaaccaaccgtcttatgaataaagttaccttgttgaatgtcacggatattcattcaccttgtaaagagcag

SEQ ID NO: 31418 - DNA, 375 bp, Homo sapiens
ggtagccatctggtaaatatacacagccaatgagttgttcttagaaaattgtcaaatttagatttttcttccagattaaaaaaaaagacagccaggcatggtgtctcacacctgtaatcccagcactttgggaggccaaggtgggcagatcatgaggtcaggagttcaagaccagcctgaccagtatggtgaaaccctgtctctactaaaaatacaaatattagccaggtgtggtagcgcgtgcctgtagtcccagttatttgggaggctgaggcaggagaatcacttaagtcggcagtcggggttgcagtgagccaagattgtgccactgcactccagcctgggtgacagagaaagactccgtctcaaaaaaaa

SEQ ID NO: 31419 - DNA, 1147 bp, Homo sapiens
ttaatagagatgaggtctcactatattgcccaggctggtctccaactcctgagctcaagtgatcttcctgccttagcctctccaagtgctgggattacagatgtgagccactgcacctggccaacaaacttctgattcttatagaatcagatgtaattccttagagacctgagaagttctatactcaggttctttcgtgccgtctgactccaagagctcttgcctgaaggaggtcccttccaggacactgagtcccaacccacaccacctccttggagggcgtgtgccctctcttccgctgaccttgacattcttgcacaggctgcttgtgcacagaggcatcacctcccagaggggacctctggagtggccccaggtaccaggtacagtcagccgcttctacctgtggaaggcgatcagggtagaaagctctgggaagcactaaaaatacacacaacccttacaaacacaactcggtgatacatgctaatagttctggactccaaactggggccaaagcacagactccacagctagttctagcatgtagcagatgtcacccaacctggaaagctacttggttgaaacttagttaaatccgtggccacagcagttttatacttgacctgagtcctccaatgtctgccacacctgcagtggcttccttcccattctctctctcctctaaaatacaagaggcatttccccccagtgcaggaagatggaacagactattttggttaatcatctacatttgtgttcttgagtttcttctggagttgtccagcctggggctgcatgcacattggcccaccacaaatgcctccctctgcggagagtgaggtgggccggtcggggcagaacgcctgcttctcaatgcaccccttgctcactcagctctgggagcccccctgccagcgtgcccgagagctactctaaatgaagttcgagctccatttcaggaaggtggtgagacaataaaataacccaggatgacgtgaacagttttgcatttgcttcaaactctgaaaggattcatggttcccacggcctccagactggatggaccactttgggtttcaatggcaggatgatttttctgtaaaacaatggctggctttaaatttcttcttctagaacaaaccaa

SEQ ID NO: 31420 - DNA, 235 bp, Homo sapiens
gactttttcaaagcatgtttcaagtgataatttcagagtctaactttctggtagaggactctagagctaggtcacacaattgcgtcacatagaggcttatgccccagagtatgaacttgcaatttctctgaatatattatataaatcaaataaggtatagatttaaaaacagtatgaaaagtttaaaaaatttcaaagtatattaacagtaattataattgtgtaaagtaagaat

SEQ ID NO: 31421 - DNA, 957 bp, Homo sapiens
atgcagagagccaatcactccacagtgacccaattcatcctcgtcggcttctctgtcttcccccacctccagctgatgctcttcctgctgttcctgctgatgtacctgttcacgctgctgggcaacctgctcatcatggccaccgtctggagcgagcgcagcctccacacgcccatgtacctcttcctgtgcgccctctccgtctccgagatcctctacaccgtggccatcatcccgcgcatgctggccgacctgctgtccacccagcgctccatcgccttcctggcctgtgccagtcagatgttcttctccttcagcttcggcttcacccactccttcctgctcaccgtcatgggctacgaccgctacgtggccatctgccaccccctgcgctacaacgtgctcatgagcccgcggggctgcgcctgcctggtgggctgctcctgggctggtggcttggtcatggggatggtggtgacctcggccattttccacctcgccttctgtggacacaaggagatccaccattttgcttgccatgtgccacctctgttgaagttggcctgtggagacgatgtgctggtggtggccaaaggcgtgggcttggtgtgtatcacggccctgctgggctgttttctcctcatcctcctctcctatgccttcatcgtggccgccatcttgaagatcccttctgctgaaggtcggaacaaggccttctccacctgtgcctctcacctcactgtggtggtcgtgcactatggctttgcctccgtcatttacctgaagcccaaaagtccccagtctctggaaggagacaccttgatgggcatcacctacacggtcctcacacccttcctcagccccatcatcttcagcctcaggaacaaggagctgaaggtcgccatgaagaagaccttcttcagtaaactctacccagaaaaaaatgtaatgatgtag

SEQ ID NO: 31422 - DNA, 2135 bp, Homo sapiens
tccatctcaaaaaaaaaaaaaaaagaaaaatattaataattgaccttggctgtatattaaaatagttacttttatagtagagcacatttctcaaacatgccctgaaaggcttttatcaagctcatataaagttaaagctttgagctaccttttcttggccaataaagtcactgacagtttatgtaaacattaatttcaacatggctgttgcattttaattatcaaaaatgtttaaaatgctttaagatgacacatagagaacatacacatacatacaaattagtgcatttgtaatttgttaaatttgaaatgaactattaccttgaaatatagtctttaaaaatttttaatggttaaagattaaattgaatgaaactgtagtctaatggtaactgatgatctgaatccgtctctctgataacctcctttccattttgaaaatgtgtcttattatacatggaagctagtaactacgtgaatgctgttggcaggatgagggtctgggtacctcagtctcttgtcctgtttccttcccccaaatccaccattgtgaagttgccaaccccctgccgccttcccctgccaagtacatgttgtcagagtcagccctataatgttcatttcccctcttgtttgtgggattatggatctctgcagaaatctgcatgccaattaacccatttctaaagcagaatccattttgcatgtcacaatcaagatgtacttggcaatctaagacacactgggagactgtaagaggaattaatatagaaaagctcttaattataataacatttggaagaaatttttcctttgttttgtaaagtggctaaggttgtaggagtgtgtggtatttattaccttttaaatgaactgtaaatttgccttagaaatttgtttaaaaggctagcaagtgagacccttgaggatgatcatatactaataaagattaccaaaagaaacttcttgtcctgttaggtcagtgttatgatttaatggttttaattacttaaccaattttaagaattgacaatttttaaaaatatttttttctaccattctaaagtaatgtcttttgttgtgggtttatgtgtaactacaggattttggaacataaacattttgaaggatagtcaatggtatttagtcttggatataaaaatagagaaaatttatagctttatgttattaaaataatttatcacacagagtgatttgaggttttcgcagagtagatttgtttgactcatggtttattagtctggattacttaagaacaatatgttgattttaatgttaattcccactaaatatataatattgataaatacatgtgaaattaatattgtttggaaaatgtagaggacacagctgggaattatgaatgcttttttcttaataggtttggtgtgtgtggctttgaatggttctgctgatgcatcatggaaagacagcagggaactgtagcctgccatcaaaactgtatcaactcttttaatgagcatgtgactgtattaggtacattttgaagaatataagtactgatgataaagtctagtatgcataataggattttggaggcatttcaggaattttccttttatagtatgctttttaggcatctgtatgtgtaatatcatagtatcatttattgctgggatggatcgaaaagcactgcttttacttttctgataagtatcaaaatgattttccagtaccaacttgactggcttttaattattgtcacacacacacaaaattcaactcctcaaggtttgggaaaattgtgtatttttttgtatacaagataaaagtgtcataaaaaggaatggatgaattgttgataggaacattagcagttaatttttacctgatactgagtttactgtaaaataggaaatgcataggaaggaatacctcctaaataatatgccttatagaatgatgaaatcttaccatagttcatactgaaaatgttgtttatttaaaagtattgtggagtgttgaaaataaagatacacaataagtattttctgaagagaaaattaatgaaggtatttaatgatataggaaataagtgacaagttaaagtccattttgtttcaataaaggagttgtgcaaactcaaaaaaaaa

SEQ ID NO: 31423 - DNA, 2093 bp, Homo sapiens
tccatctcaaaaaaaaaaaaaaaagaaaaatattaataattgaccttggctgtatattaaaatagttacttttatagtagagcacatttctcaaacatgccctgaaaggcttttatcaagctcatataaagttaaagctttgagctaccttttcttggccaataaagtcactgacagtttatgtaaacattaatttcaacatggctgttgcattttaattatcaaaaatgtttaaaatgctttaatttgtaatttgttaaatttgaaatgaactattaccttgaaatatagtctttaaaaatttttaatggttaaagattaaattgaatgaaactgtagtctaatggtaactgatgatctgaatccgtctctctgataacctcctttccattttgaaaatgtgtcttattatacatggaagctagtaactacgtgaatgctgttggcaggatgagggtctgggtacctcagtctcttgtcctgtttccttcccccaaatccaccattgtgaagttgccaaccccctgccgccttcccctgccaagtacatgttgtcagagtcagccctataatgttcatttcccctcttgtttgtgggattatggatctctgcagaaatctgcatgccaattaacccatttctaaagcagaatccattttgcatgtcacaatcaagatgtacttggcaatctaagacacactgggagactgtaagaggaattaatatagaaaagctcttaattataataacatttggaagaaatttttcctttgttttgtaaagtggctaaggttgtaggagtgtgtggtatttattaccttttaaatgaactgtaaatttgccttagaaatttgtttaaaaggctagcaagtgagacccttgaggatgatcatatactaataaagattaccaaaagaaacttcttgtcctgttaggtcagtgttatgatttaatggttttaattacttaaccaattttaagaattgacaatttttaaaaatatttttttctaccattctaaagtaatgtcttttgttgtgggtttatgtgtaactacaggattttggaacataaacattttgaaggatagtcaatggtatttagtcttggatataaaaatagagaaaatttatagctttatgttattaaaataatttatcacacagagtgatttgaggttttcgcagagtagatttgtttgactcatggtttattagtctggattacttaagaacaatatgttgattttaatgttaattcccactaaatatataatattgataaatacatgtgaaattaatattgtttggaaaatgtagaggacacagctgggaattatgaatgcttttttcttaataggtttggtgtgtgtggctttgaatggttctgctgatgcatcatggaaagacagcagggaactgtagcctgccatcaaaactgtatcaactcttttaatgagcatgtgactgtattaggtacattttgaagaatataagtactgatgataaagtctagtatgcataataggattttggaggcatttcaggaattttccttttatagtatgctttttaggcatctgtatgtgtaatatcatagtatcatttattgctgggatggatcgaaaagcactgcttttacttttctgataagtatcaaaatgattttccagtaccaacttgactggcttttaattattgtcacacacacacaaaattcaactcctcaaggtttgggaaaattgtgtatttttttgtatacaagataaaagtgtcataaaaaggaatggatgaattgttgataggaacattagcagttaatttttacctgatactgagtttactgtaaaataggaaatgcataggaaggaatacctcctaaataatatgccttatagaatgatgaaatcttaccatagttcatactgaaaatgttgtttatttaaaagtattgtggagtgttgaaaataaagatacacaataagtattttctgaagagaaaattaatgaaggtatttaatgatataggaaataagtgacaagttaaagtccattttgtttcaataaaggagttgtgcaaactcaaaaaaaaa

SEQ ID NO: 31424 - DNA, 573 bp, Homo sapiens
ggatcccagtttagccatctctgatctaaaggcacgtgacttctctaatgttcatggcagacctattctgtaagcccattgtgcagccaagtcagcatgccattccagtgcagtgtgagagggcagagatgggggccaagagtacaaatagagtgggacagttgtcattgcccagcctgtgagttgaagtctgtgcagtcagccagtgggtctgacaaagagggcagtgctggcactgcctcatgcttccgcagaggtgatgaggttcaggctgaggtggagaccacgctgcactcgccatgcattcaatggtgccccatctcttgttctctaggaagcattcccgctacctgtgtgatgcagttggttccacctattcccagagactccaccctggccctccttgccctggcccccagcactgagcccctagggccatttagctggccagcatgatctaagacagctttctgcaggcattcctcttgtaggagtcatgaagcagcaatgtgtattttgcttctttttgttgttgttatattaaaaaatatttttatattctagtccaaaaaa

SEQ ID NO: 31425 - DNA, 933 bp, Homo sapiens
gagaattcaagctttaagaggaattttcttgctggactctgagtccctgtcagccctcctaagtcttagatcatgcctctgagccctgtagtactgaatcaatggggatgctttggctgcaagtaacaaaacccaaataacagtaagtaagattaagcagagctcagatctcccaaagatgctctctgctcttggaaggtctctgtacacaggaatgggatatcagtgccacttccagcaagttcctgcatgggacaggtagccataaaggctgagtgtctggagttcagagtaataggttttgtcttcttgagtcacagcctctttaatatgttgatgagaagcccagggaacgttgatgtacaaagttggacatataattcaggggattcatggatctttctctaatgttcatggcagacctattctgtaagcccattgtgcagccaagtcagcatgccattccagtgcagtgtgagagggcagagatgggggccaagagtacaaatagagtgggacagttgtcattgcccagcctgtgagttgaagtctgtgcagtcagccagtgggtctgacaaagagggcagtgctggcactgcctcatgcttccgcagaggtgatgaggttcaggctgaggtggagaccacgctgcactcgccatgcattcaatggtgccccatctcttgttctctaggaagcattcccgctacctgtgtgatgcagttggttccacctattcccagagactccaccctggccctccttgccctggcccccagcactgagcccctagggccatttagctggccagcatgatctaagacagctttctgcaggcattcctcttgtaggagtcatgaagcagcaatgtgtattttgcttctttttgttgttgttatattaaaaaatatttttatattctagtccaaaaaa

SEQ ID NO: 31426 - DNA, 521 bp, Homo sapiens
ctcagaaacgtgcttagaaaagtgcagatgcactgttattcttggccaatgcagctgagccaggtgtaggtggatgactaccccaggatgttgagctgagaaacaggatctcagcctgaacccaatgtagctcagcagatgtttgaattatgtgatctccagcttttgggaaagatctgaatgtaagaggaacttaagagaattagcatgatattttaaagagaataactgcattacattctaacagcagacctgagtcggaaaacaagtaaagaatcgatgtattggtttgccgatggaagagcttcagtgagatctcagaccctgaccctgcagtgagccttggcaatgattgacagggaagtttgtaggataacgcagaagtaggattagtgtgccactgctccaggctgaaaatcagaaatgaaagctaaaatacatttgtacataagctataccttcaattgatagagcaagctgtgtgactcaaaacagcctgtacagaagtacgatggaccagc

SEQ ID NO: 31427 - DNA, 342 bp, Homo sapiens
tttgttttgtttttgagacagagtcttactcggttgcccaggctggagtgcaggttgcagtgagcccagattgcgctactgcactccagcctgggcagtcaaggaagactccatctcaaaaaaaagaaaaagaaaaagaaaaaaaattgaatccaaatattaggagatttcttagtgaggtgccaaacctaagtatttggtaactgaattggctaaattattggctgatattttggttttgtaaacaatcacatagagatctcttatgattctgccctatatgaatgttgagttttcttcttttgggtcactgaatgtttctagatcaataggaacccagcc

SEQ ID NO: 31428 - DNA, 767 bp, Homo sapiens
ttacaggttcatatgcagaagggacttgccttttctcagatgagatgttggactcggacttttgagttaatgctgaaatgagctaagactttggggaactgttgggaagacatgatcggttttgaaatgcgagaaggacatgagatgtgggaggggccaagggtggaattataaggtttagctctgtgtccccacccaaatttcatctcgaattgtaattcctaatgttggggaagggacctggtgggaagtgattggatcatgggggtggacttccctcatgctgttctcctgataatgagtgagttctcatgagatctgcttgtttaaaggtgtatggcacttccccccttgctcacgctttctctcttctgctgccatgagaagaaagtgcttgctttccctttgcttttctcccatgattcagtttctgaggcctcccagtcatgcttcctgttaagtctgtggaacttggagtcaattaaacctcttttcttcataaattacccagtctcaggtggttctttatagcagtgtgagaacagactaatgtactaagcaataagaaagatgtccaggccccaaatgccccaacctgacacctagctggctcttaaagagggtagctactgtgaagagggagaaaaaggccttggcatctgcagaccctctttctttatgatcctttaaatataaaggatgtgtttatgtctgtcttcctaagtaggaagttttattctttaaactaaatttgacctactggcatg

SEQ ID NO: 31429 - DNA, 963 bp, Homo sapiens
atggaccaaagcaattatagttctttacatggttttattctgcttggcttctctaaccatccaaaaatggagatgatcctgtcaggagttgtcgccatcttctacttaattacattggtgggtaacacagccatcattcttgcatctctcctggattcccagcttcatacaccaatgtactttttcctcagaaatttatctttcctagatctatgtttcacaaccagcatcatccctcagatgctggtcaacttgtggggacctgataagaccatcagctatgtgggttgtatcatccaactctatgtttacatgtggttgggctcagttgagtgccttctcctggctgttatgtcctatgatcgttttacagctatatgtaagcccttgcattattttgtagtcatgaacccacatctatgtctaaagatgattatcatgatctggagtattagtttggccaattctgtagtattatgtacactcactctgaatttgcccacatgtggaaacaacattctggatcatttcttgtgtgagttgccagctctggtcaagatagcttgtgtagacaccacaacagttgaaatgtctgttttcgctttaggcattataattgtcctcacacctctcatccttattcttatatcctatggctacattgccaaagctgtgctgagaacgaagtcaaaagcaagccagcgaaaagcaatgaatacctgtggatctcatcttactgtagtgtctatgttctatggaactattatctacatgtacctgcaaccaggtaacagggcttccaaagaccagggcaagttcctcaccctcttttacaccgtcatcactccaagtctcaacccgctcatttacaccttaagaaataaggacatgaaggatgccctgaagaaactgatgagatttcaccacaaatctacaaaaataaagaggaattgcaagtcatag

SEQ ID NO: 31430 - DNA, 320 bp, Homo sapiens
tgcaagggagtttcactctttttgcaacccccgcctcccaggttgaagcgattttcctgcctcagcctcccgagtagctggaaacacaggctcgcatcaccacgcccagctaattttgtattttcagtacagacagggttttgccatgttggccgggctggtctcgaactcctgatttcaggtgatccagtggcctcggcttcccaaagtgctggggattgcgggcgtgacacccatgactgggctaatttttgtattttaagtaggagacagatttcactatgttgaccagggttgtcttgaactcctgacctcaggtg

SEQ ID NO: 31431 - DNA, 394 bp, Homo sapiens
gaagtagctaggaccacgggcacatgtcaccacactcagctaatttttcaattttttgtagagataaggtctctacaaaaaatgttttttgtctaggctggtctcgaactcctgggctcaagcaatcctcctgctttggcctcccaaagttctgggattataggtgtgagccactgtacccagcctgtatttcattttctgcttcattaaagccactaccaaatttgagaacttggtggtttagtggagaaatttatcatagtgaccatttcatttgactatgaataagatttaatgtttgaataatgtgagaagtttgggccagtttcacagattttatagttgcagagtgctgccatgcagctttctctgtgagttagtccttcgatgcaaa

SEQ ID NO: 31432 - DNA, 605 bp, Homo sapiens
gcggccgcagagcactttgcccggagcccagcgtcctcccctgagttcgctgagtctcccgggaccagcaaaggctgcgcgccccgcatcggcccggaggcggggagccctgggaggcctggccgagctgcccgcagggaaatggcggagaaagcgcttctctgcccgagttcagccgggctggggacttggccctgggtcctgaactcggcatggccagttctgcctctggctgtggaccagggtgtggactggagaccgcgggggccaggtgtgtgggcaaaccggctttggcgagcgacagaccggctgtgaaccctgccagctgcacttcctggctgtgtgaccttgggctagtcactttacctctctgattctcagctttccttctctgttgtaagagttctcctagtacctggtagacgctcaggaaatgggagctgcagatattttgggaaagagctagctcctggcacctgcttcaagtgcagagaaccagcgtccagtattgatcaccaagagagggtggcccagctgtttgtgtgtcagctgaaaagcaacccctcttgacccccaatctaaatacccctttccaggagaactgg

SEQ ID NO: 31433 - DNA, 1623 bp, Homo sapiens
gcggccgcagagcactttgcccggagcccagcgtcctcccctgagttcgctgagtctcccgggaccagcaaaggctgcgcgccccgcatcggcccggaggcggggagccctgggaggcctggccgagctgcccgcagggaaatggcggagaaagcgcttctctgcccgagttcagccgggctggggacttggccctgggtcctgaactcggcatggccagttctgcctctggctgtggaccagggtgtggactggagaccgcgggggccagtctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaggtttgttaattaaaaaaaaaaaaaaaaaaatcaaaaacaacaaaacaaagggggggcgcgccgactaaaagaataccccccagagggggcggcccaggttattacagggtagcaccacgagttttttatggaaaaaggggggccccataataggaggcggcgctaatatataaccgacgagggacactagggcgcggtgttttaaaaacgctgctaagatcggtggcaaaaaagacgtcgcataagcgtgaggaaacatcattgtggaaaaagaacggaccccctcaacttcagccgggcggagaggagacacaatatatggggggcacacaaaacaacctcccctcaccgggcgagaaatttattagacgcgccccaagcagggcaagacatattcaacaaacctttaacaacagggtgactcaataaggcgggtgtctcaacacaacaaagacgcggacaaaaatatgagccatggccccgcttcatagagaaaaagtatctggcgcatcaacgcggagcagcaaatctaatcttgatcgccaaaaacattttttattcccccggcg

SEQ ID NO: 31434 - DNA, 1396 bp, Homo sapiens
atatcttatgatggtgcgggagctcgaggtgctagtaacgcgcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaggtttgttaattaaaaaaaaaaaaaaaaaaatcaaaaacaacaaaacaaagggggggcgcgccgactaaaagaataccccccagagggggcggcccaggttattacagggtagcaccacgagttttttatggaaaaaggggggccccataataggaggcggcgctaatatataaccgacgagggacactagggcgcggtgttttaaaaacgctgctaagatcggtggcaaaaaagacgtcgcataagcgtgaggaaacatcattgtggaaaaagaacggaccccctcaacttcagccgggcggagaggagacacaatatatggggggcacacaaaacaacctcccctcaccgggcgagaaatttattagacgcgccccaagcagggcaagacatattcaacaaacctttaacaacagggtgactcaataaggcgggtgtctcaacacaacaaagacgcggacaaaaatatgagccatggccccgcttcatagagaaaaagtatctggcgcatcaacgcggagcagcaaatctaatcttgatcgccaaaaacattttttattcccccggcg

SEQ ID NO: 31435 - DNA, 1569 bp, Homo sapiens
agatccagcaggtgcgcgaaaccgcggcgcgccgccctccgccgttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatgatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaggtttgttaattaaaaaaaaaaaaaaaaaaatcaaaaacaacaaaacaaagggggggcgcgccgactaaaagaataccccccagagggggcggcccaggttattacagggtagcaccacgagttttttatggaaaaaggggggccccataataggaggcggcgctaatatataaccgacgagggacactagggcgcggtgttttaaaaacgctgctaagatcggtggcaaaaaagacgtcgcataagcgtgaggaaacatcattgtggaaaaagaacggaccccctcaacttcagccgggcggagaggagacacaatatatggggggcacacaaaacaacctcccctcaccgggcgagaaatttattagacgcgccccaagcagggcaagacatattcaacaaacctttaacaacagggtgactcaataaggcgggtgtctcaacacaacaaagacgcggacaaaaatatgagccatggccccgcttcatagagaaaaagtatctggcgcatcaacgcggagcagcaaatctaatcttgatcgccaaaaacattttttattcccccggcg

SEQ ID NO: 31436 - DNA, 1426 bp, Homo sapiens
agatccagcaggtgcgcgaaaccgcggcgcgccgccctccgccgttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatcttgtggcttcctgggactagaagggggttgtgcggtggatgtgaaacaaggcccttgatgcaaagacctgggttccagtgtggcccgtctcaccagccatgtgaccttgaaccttgacccagaacgtgggtatgccgatcatgcgtggttctgagggctgggtaagatcacacagtcagcctttggcacacaggaagcgctccctaaagtcagtttcctcctctccctcctccatgggctgtgctattgctgggttcctgagaccagccccactatgttctggctcccgagtgggttcagttgtggtcccagctggccagccgcacaggtcccaggcagtgccccgagtcacatctccttttcctgtggcctttcccatgactcctgacatccctctgtgtcccgccccaggtcagcctcctcatcaagaaaatgtaaacatgggacttcgctatatttagcactggaatgtgtatgcggggctggtgggaacagcccgggtggcgggggtggatccctggtgtgagcctggcttcctgtctgctccaaggggcgtggaacaggacggactcaggtccaaatccctggtttcctgtcccttagtggtgtggccgtgggcaaacgccttaacttccgtgagctttgacagtctgtctgggaggcagggctcaggcatccctggcctcttggggttgggtgagagggagacagaggtttgtgaagcgctttgcacacctgggcatctggtcagtgttcagtaaatgccagctgggctcagtggtgcactcctgtaatcccagcactttaggaggctgagtggggaggatcacttgaagccacgagttcagggctcagcctgggcagcagag

SEQ ID NO: 31437 - DNA, 1084 bp, Homo sapiens
gcggccgcagagcactttgcccggagcccagcgtcctcccctgagttcgctgagtctcccgggaccagcaaaggctgcgcgccccgcatcggcccggaggcggggagccctgggaggcctggccgagctgcccgcagggaaatggcggagaaagcgcttctctgcccgagttcagccgggctggggacttggccctgggtcctgaactcggcatggccagttctgcctctggctgtggaccagggtgtggactggagaccgcgggggccagtctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggtacatagccaaggctcgtctgcgcaccttgtgtcttgtagggtatggtatgtgggacttcgctgtttttatctccaataaaaaaaaaaaaaggtttgttaattaaaaaaaaaaaaaaaaaaatcaaaaacaacaaaacaaagggggggcgcgccgactaaaagaataccccccagagggggcggcccaggttattacagggtagcaccacgagttttttatggaaaaaggggggccccataataggaggcggcgctaatatataaccgacgagggacactagggcgcggtgttttaaaaacgctgctaagatcggtggcaaaaaagacgtcgcataagcgtgaggaaacatcattgtggaaaaagaacggaccccctcaacttcagccgggcggagaggagacacaatatatggggggcacacaaaacaacctcccctcaccgggcgagaaatttattagacgcgccccaagcagggcaagacatattcaacaaacctttaacaacagggtgactcaataaggcgggtgtctcaacacaacaaagacgcggacaaaaatatgagccatggccccgcttcatagagaaaaagtatctggcgcatcaacgcggagcagcaaatctaatcttgatcgccaaaaacattttttattcccccggcg

SEQ ID NO: 31438 - DNA, 973 bp, Homo sapiens
gcttgggggcttggagggcttggggccaccagccctcgtccctgtgaggctggcattgctgtctcccgttcccggcaccttcatcctaaacattcctcagcagcttgtggcttcctgggactagaagggggttgtgcggtggatgtgaaacaaggcccttgatgcaaagacctgggttccagtgtggcccgtctcaccagccatgtgaccttgaaccttgacccagaacgtgggtatgccgatcatgcgtggttctgagggctgggtaagatcacacagtcagcctttggcacacaggaagcgctccctaaagtcagtttcctcctctccctcctccatgggctgtgctattgctgggttcctgagaccagccccactatgttctggctcccgagtgggttcagttgtggtcccagctggccagccgcacaggtcccaggcagtgccccgagtcacatctccttttcctgtggcctttcccatgactcctgacatccctctgtgtcccgccccaggtcagcctcctcatcaagaaaatgtaaacatgggacttcgctatatttagcactggaatgtgtatgcggggctggtgggaacagcccgggtggcgggggtggatccctggtgtgagcctggcttcctgtctgctccaaggggcgtggaacaggacggactcaggtccaaatccctggtttcctgtcccttagtggtgtggccgtgggcaaacgccttaacttccgtgagctttgacagtctgtctgggaggcagggctcaggcatccctggcctcttggggttgggtgagagggagacagaggtttgtgaagcgctttgcacacctgggcatctggtcagtgttcagtaaatgccagctgggctcagtggtgcactcctgtaatcccagcactttaggaggctgagtggggaggatcacttgaagccacgagttcagggctcagcctgggcagcagag

SEQ ID NO: 31439 - DNA, 1617 bp, Homo sapiens
agatccagcaggtgcgcgaaaccgcggcgcgccgccctccgccgttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaggtttgttaattaaaaaaaaaaaaaaaaaaatcaaaaacaacaaaacaaagggggggcgcgccgactaaaagaataccccccagagggggcggcccaggttattacagggtagcaccacgagttttttatggaaaaaggggggccccataataggaggcggcgctaatatataaccgacgagggacactagggcgcggtgttttaaaaacgctgctaagatcggtggcaaaaaagacgtcgcataagcgtgaggaaacatcattgtggaaaaagaacggaccccctcaacttcagccgggcggagaggagacacaatatatggggggcacacaaaacaacctcccctcaccgggcgagaaatttattagacgcgccccaagcagggcaagacatattcaacaaacctttaacaacagggtgactcaataaggcgggtgtctcaacacaacaaagacgcggacaaaaatatgagccatggccccgcttcatagagaaaaagtatctggcgcatcaacgcggagcagcaaatctaatcttgatcgccaaaaacattttttattcccccggcg

SEQ ID NO: 31440 - DNA, 1268 bp, Homo sapiens
caaagacagagtggaatccggtgccctcacctccttttaaatcctggttctcagagaaaggactcaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaggtttgttaattaaaaaaaaaaaaaaaaaaatcaaaaacaacaaaacaaagggggggcgcgccgactaaaagaataccccccagagggggcggcccaggttattacagggtagcaccacgagttttttatggaaaaaggggggccccataataggaggcggcgctaatatataaccgacgagggacactagggcgcggtgttttaaaaacgctgctaagatcggtggcaaaaaagacgtcgcataagcgtgaggaaacatcattgtggaaaaagaacggaccccctcaacttcagccgggcggagaggagacacaatatatggggggcacacaaaacaacctcccctcaccgggcgagaaatttattagacgcgccccaagcagggcaagacatattcaacaaacctttaacaacagggtgactcaataaggcgggtgtctcaacacaacaaagacgcggacaaaaatatgagccatggccccgcttcatagagaaaaagtatctggcgcatcaacgcggagcagcaaatctaatcttgatcgccaaaaacattttttattcccccggcg

SEQ ID NO: 31441 - DNA, 1624 bp, Homo sapiens
  misc_feature (760)..(761): n is a, c, g, or t
  misc_feature (763)..(764): n is a, c, g, or t
agatccagcaggtgcgcgaaaccgcggcgcgccgccctccgccgttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatgaacctgaacaaaaaaaaaaaaaaaaaacagaaannannacaaaacaaaaatcaaaatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaggtttgttaattaaaaaaaaaaaaaaaaaaatcaaaaacaacaaaacaaagggggggcgcgccgactaaaagaataccccccagagggggcggcccaggttattacagggtagcaccacgagttttttatggaaaaaggggggccccataataggaggcggcgctaatatataaccgacgagggacactagggcgcggtgttttaaaaacgctgctaagatcggtggcaaaaaagacgtcgcataagcgtgaggaaacatcattgtggaaaaagaacggaccccctcaacttcagccgggcggagaggagacacaatatatggggggcacacaaaacaacctcccctcaccgggcgagaaatttattagacgcgccccaagcagggcaagacatattcaacaaacctttaacaacagggtgactcaataaggcgggtgtctcaacacaacaaagacgcggacaaaaatatgagccatggccccgcttcatagagaaaaagtatctggcgcatcaacgcggagcagcaaatctaatcttgatcgccaaaaacattttttattcccccggcg

SEQ ID NO: 31442 - DNA, 939 bp, Homo sapiens
acggtaggtgggaagggccgaggaccggggggcctggtcaggtgtgaaggtggcggcgggaacgtgcccttaacgctgctccgtcccttccagatcatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaggtttgttaattaaaaaaaaaaaaaaaaaaatcaaaaacaacaaaacaaagggggggcgcgccgactaaaagaataccccccagagggggcggcccaggttattacagggtagcaccacgagttttttatggaaaaaggggggccccataataggaggcggcgctaatatataaccgacgagggacactagggcgcggtgttttaaaaacgctgctaagatcggtggcaaaaaagacgtcgcataagcgtgaggaaacatcattgtggaaaaagaacggaccccctcaacttcagccgggcggagaggagacacaatatatggggggcacacaaaacaacctcccctcaccgggcgagaaatttattagacgcgccccaagcagggcaagacatattcaacaaacctttaacaacagggtgactcaataaggcgggtgtctcaacacaacaaagacgcggacaaaaatatgagccatggccccgcttcatagagaaaaagtatctggcgcatcaacgcggagcagcaaatctaatcttgatcgccaaaaacattttttattcccccggcg

SEQ ID NO: 31443 - DNA, 628 bp, Homo sapiens
tcttggagaaagggccatctaggttgaaacttaagggttagtagacctaacaagattaaaagcctgagggatctaaagccttgggacttctggatctgcaagtggtccctgttttggtagctattgactgacgaggggctcttcgccccacaggtgactgctgtagccttgagtgaggacctcggccaaaaagaaggctcctaccgtggctgtttgctgatggtcttcgcagagcctgctgtctttgagcttcctgagagagggacactaccctcgcttaggtgagtgctccaggtccatggggcctgatgctctgtccctggtctggcttccgcccatgtatacatttgcactcttgatggtggcttaggatctgcttccaacaagtctgccaaatgtgctctgtaacacagggggaccctccaaatgtgcattgctttctgtcagtctcaggaaacccattcccttcccagcctatctcagaaacggagagtggtggctcagtggcctctggctctggcacagccccttgatgggtccacagtggcccctctgcccttggctctgttggcttcccaacagatgttcctcttcacatgtagtcctaagaactcaatcagtttaaaaa

SEQ ID NO: 31444 - DNA, 409 bp, Homo sapiens
ggagcagtaaacagcaattgaagacagagcagtactcttgggctttgcccccagtgtggaattctagtgagctggaatcgactacgttgaagacattttttttaatgccaggaagccaaagtagctttgaacccaaagcaggacaaaggtcattttctctttctctaaagccctgatggggtttgaccactcttgtaaagtatcagtaccagagaaaaagtaaaaagagcaaatgagacagttcctgaatgagtattttccctaatgcatatgtagagcagtccaggtctccccatacaagtgcccttgatgtcctccagtggaagaaaaataggtcccagccatttgtgctcactctgaaaaacctgtcttccggctgggcgcggtggctcacgcctataatcccagc

SEQ ID NO: 31445 - DNA, 648 bp, Homo sapiens
gttcatgtcctttgcagggacatggatgaagctggaaaccattgttatcagcaaactaacacaggaacagaaaaccaaacaccacatattctcacttataagtgggaattgaacaatgagaacacatggacacagggaggggaacatcacacaacggggcctgttgaggggtagggggctagaggagggatagcattagcagaaatacctaatgtagatgacaggtcgatggatgcagcaaaccaccatggcacgtgtatacctatgtaacctgcacgttctgcacatgtatcccagaacttaaagtataattttaaaaaaagggaaaaaaagtaaaaaaaaaaaataaacaaatcagcaaactacacagaagaatattagaacaatttctctcaaatttctcttccattgagcttcctgcctgaccctagagctccctcacctctttggcttaccagctcccatccttcaaagtttctgagttattctgtggggaatttgagctactctcttcctttaggtccaggccatctcagctaggtccagagagcctcactcacctccccaactaagcaagcatccctggaggtatgttcttcatgcaagggcagttcctgagagaatttatttggttagctcataaaggga

SEQ ID NO: 31446 - DNA, 543 bp, Homo sapiens
attagaataaaaacaaactatgaaatcaaaatagaaattaactacatgtcaactaaagtgttttttaaagcatgtttttaaaccaaaagataatctttgccccattcttcattcattttattggaataatacactctgccaaagcatgtaagtgttagggttcatgtacacacacagatttatcattaaaacctggaaactgctctcctcccacataatttctatatttggtattgaatcaaagctgtagaagggacagagcttccacaatttgttctgtccacaccctatgggttagctgcaaagtatgttaattttaaaagagatggtgtgtctgaatttttaccttgaggaaaccagggacgttagaaatttgccaaaggtcacacagctcactgatagtggagtcccacccaaccagagttctgtctttgattcaaggctgtttttatgctactgcctttgcctgcttttataggcactaaaggaatataagctgggttgaaatgagtgaagacagttacaacagaagcaaaaaaaaaa

SEQ ID NO: 31447 - DNA, 345 bp, Homo sapiens
ttttgaatgatagcagatttctcatcaaaacccataaagactggaagtaaatggttacattttttgaaatgctgtaacaaaagtactataaattcaaaatcttaaatctagcaaaaatatccttcaagagttaaggtgaaatgcaaagcattctcagatgaaggaaatctaagaacatttgtcaccacaggcttactctaaaagaatgaataaaggcagttttagaaacagatagataggaaataataggagaatcactagaaccagggaggcaaaggttgcaatgagccgagatcgtcccattgcactctagcctgggcaacaagagcaaaactccatctcaaa

SEQ ID NO: 31448 - DNA, 463 bp, Homo sapiens
ggaggttgcagtgagccaaggttgtgccagtgtgctccagcgtgggcagcctgggcaacagagcgacactctgtcaaaaaagaaaaaatcaacttataaacacagaagagttgaaaaaatactacagtgaacacctatatgctattcaattggattcaccagttaccattttgttatatttgctttctctccctagcatatgtaagattgtatatgtgccctttttttaagtaagttgccaatctcatggcacttcacttttaagtacttttgcagatatcgtctaagaactaggacattctcctatgtaatcacagtaccattaatccacccaaaaaatttaacaatacgctaatgatacctaatgtatagtttgtaatcagctttcttgtagtaatctgttttgaaggcttgcatcctgtcatggtccactgattaaattttgaacttcaacctgaaactg

SEQ ID NO: 31449 - DNA, 528 bp, Homo sapiens
ggtggggggacgggagggggtcccttctccccctcttggcgacagtgaccatggcattgggctcagcagaccccctcccacatacaccaggccccgcaaatccctgtgaccagtttcactgccaccatcttggtgagcgtgtggtgtctgacctccagaaatgcacatcgacccccagccagcccggtgactttgtcacctgtgttcaagtgatggctccccttcccttcacacccacacccacctgacctggggacacctggggccagtgtgactctaggcctgctcccgccgcgccccagcatacatccacctgctttctgatcagtcccaccacctcggtacctacctccctgacaccttgtcatcctagatcagtacctctcgcttcacacacacctggcctgggaacactgaccatatctagtctcccggctttttccccaagatcctggtctctaaatcctctgggctggaggaaattagattttcaaaccctgtgaacaccacccctgacccatgatcctt

SEQ ID NO: 31450 - DNA, 1477 bp, Homo sapiens
  misc_feature (1)..(1): n is a, c, g, or t
  misc_feature (3)..(4): n is a, c, g, or t
nanncgcaggcggtgtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccaccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccagcgctaccaggcagaaatcaacgacctggagaacttgggcgagatgggcagcggcacctgcggccaggtgtggaagatgcgcttccggaagaccggccacgtcattgccgttaagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcacccgagcgcattgaccccccagaccccaccaagccggactatgacatccgggccgacgtatggagcctgggcatctcgttggtggagctggcaacaggacagtttccctacaagaactgcaagacggactttgaggtcctcaccaaagtcctacaggaagagcccccgcttctgcccggacacatgggcttctcgggggacttccagtccttcgtcaaagactgccttactaaagatcacaggaagagaccaaagtataataagctacttgaacacagcttcatcaagcgctacgagacgctggaggtggacgtggcgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccaggggagacctgggacctggacggccacctaggactgaggacagagagtggggggtgccc

SEQ ID NO: 31451 - DNA, 1536 bp, Homo sapiens
  misc_feature (1)..(1): n is a, c, g, or t
  misc_feature (3)..(4): n is a, c, g, or t
  misc_feature (1093)..(1093): n is a, c, g, or t
  misc_feature (1536)..(1536): n is a, c, g, or t
nanncgcaggcggtgtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccaggactgtctggcgcccccctcccccggcctgggggcttgtcagccccgtgcagcgacgatctacgcacacgcgcacgcctggctcggggacacctgagttattgtgatcactctaagccctgctcctgccccgtcccaacgagcaggtaccagcctttttatcatcgctgcttggacatctgcaccattgacctaaccgctgccccggccgcagaatggcgtcccccagcccccatgctctgtgtgtgtccccatgtcccttcccctcactctcactttctctctcactccactcaagcagcggtcagcccagcccagcctcctctgcgtcctccctcctcctccccctcccttactcccagctccactttggactccctggaggaggaggtgggctcccccactgaatgggagtctgtggcctccgggggtggggggggtgcacgcctgtgtgtgtgtaactgagagaacgagaaagttgggcctggtgggtgggtggcctgtgcctatggatctctctcaacaactaggtgaacacatagcaccccccgggttccataccagccctgggcgccagggacacagcagtgaatagaacagatggagcccctctcctctgtagcggggggctgcaataggggggcccactggacaaggagcacattcccaccagagagaacattctagctgggtgagcggccctgcagggggccagcctgggggaacctctggagacggtgggaattgaacaaagcctctggggaggccaggcacggtggctcacacctgtgatcccaacactcggggaggttgaggctacagggagccatgatcacaccactgcaccccagcctgggtgacagcgagatcctgtctcaaaaatttaaaaactggnccaggcgcagtggctcatgcctgtaatttcagtactttgggaggccaaggagggtggatcacttgaggtcaggagttcgagaccagcctggccaacatggtgaaaccctgtctgcattaaaaatactagagattaggccaggcacagtgactcacacctgtaattccagcactttgggagaccgaggcgggtggctcacctgaggtcgggagttcgagaccaccctgaccaacatagagaaaccccgtctccactaaaaatacaaaattagccgggcatggtggcacatacctgtaatcccagctactcgggaggctgtaatcctagctactcgggaggctgaggcaggagaaccgcttgaacccgggaggcggagattgcagtgagctgagatcgcaccattgcacttcagcctgggcaacaagagcaaaactccatctcan

SEQ ID NO: 31452 - DNA, 1129 bp, Homo sapiens
  misc_feature (1)..(1): n is a, c, g, or t
  misc_feature (3)..(4): n is a, c, g, or t
nanncgcaggcggtgtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccaccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccagcgctaccaggcagaaatcaacgacctggagaacttgggcgagatgggcagcggcacctgcggccaggtgtggaagatgcgcttccggaagaccggccacgtcattgccgttaagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcagtgagtgggggccccccagcgggggagggggtgggggctgggaggccggccccagccttggagatacgtctcctcctcccccccctgcagcccgagcgcattgaccccccagaccccaccaagccggactatgacatccgggccgacgtatggagcctgggcatctcgttggtgagttgggccctcccctgttctccagc

SEQ ID NO: 31453 - DNA, 1189 bp, Homo sapiens
cgaacatgctaccgctctgggcaacattgttcacacccctcagtacggagagcattgagattgaccagaagctgcaggagatcatgaagcagacgggctacctgaccatcgggggccagcgctaccaggcagaaatcaacgacctggagaacttgggcgagatgggcagcggcacctgcggccaggtgtggaagatgcgcttccggaagaccggccacgtcattgccgttaagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcacccgagcgcattgaccccccagaccccaccaagccggactatgacatccgggccgacgtatggagcctgggcatctcgttggtggagctggcaacaggacagtttccctacaagaactgcaagacggactttgaggtcctcaccaaagtcctacaggaagagcccccgcttctgcccggacacatgggcttctcgggggacttccagtccttcgtcaaagactgccttactaaagatcacaggaagagaccaaagtataataagctacttgaacacagcttcatcaagcgctacgagacgctggaggtggacgtggcgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccaggggagacctgggacctggacggccacctaggactgaggacagagagtggggggtgccc

SEQ ID NO: 31454 - DNA, 1556 bp, Homo sapiens
  misc_feature (1)..(1): n is a, c, g, or t
  misc_feature (3)..(4): n is a, c, g, or t
nanncgcaggcggtgtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccaccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccagcgctaccaggcagaaatcaacgacctggagaacttgggcgagatgggcagcggcacctgcggccaggtgtggaagatgcgcttccggaagaccggccacgtcattgccgttaaggtgagccttggcggctaccccggctgcgccccacaccccaggccggtgctgaggctccctcctgtccctgcctgtgcagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcacccgagcgcattgaccccccagaccccaccaagccggactatgacatccgggccgacgtatggagcctgggcatctcgttggtggagctggcaacaggacagtttccctacaagaactgcaagacggactttgaggtcctcaccaaagtcctacaggaagagcccccgcttctgcccggacacatgggcttctcgggggacttccagtccttcgtcaaagactgccttactaaagatcacaggaagagaccaaagtataataagctacttgaacacagcttcatcaagcgctacgagacgctggaggtggacgtggcgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccaggggagacctgggacctggacggccacctaggactgaggacagagagtggggggtgccc

SEQ ID NO: 31455 - DNA, 405 bp, Homo sapiens
gcttgggagcccagttcccggacccaggcgaggcccccagctgatgacccgcccccatcgccgtgatcctctgggtcgggcttccccgactccacgcgacagtgaccacatccaggtcgccccgaaaacacagacacgtccctgttgacctgatgctaccactctcgtcatctcagggactgtctggcgcccccctcccccggcctgggggcttgtcagccccgtgcagcgacgatctacgcacacgcgcacgcctggctcggggacacctgaggttacttgaccacatagagcccctccccatctcttctgacccgaggattctccctctcgctctccctgtgaccgtgtctgaggtggggggacgggagggggtcccttctccccctcttggcgacagtgacc

SEQ ID NO: 31456 - DNA, 1606 bp, Homo sapiens
  misc_feature (1)..(1): n is a, c, g, or t
  misc_feature (3)..(4): n is a, c, g, or t
nanncgcaggcggtgtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccaccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccaggtaccaccttcactgtggcggggagagggaggaggcccagccaggctggacccatcctgggagcgccagtggggggcagggggcggtggcagagccccagggaccctccaaccctccctctcctcccagcgctaccaggcagaaatcaacgacctggagaacttgggcgagatgggcagcggcacctgcggccaggtgtggaagatgcgcttccggaagaccggccacgtcattgccgttaagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcacccgagcgcattgaccccccagaccccaccaagccggactatgacatccgggccgacgtatggagcctgggcatctcgttggtggagctggcaacaggacagtttccctacaagaactgcaagacggactttgaggtcctcaccaaagtcctacaggaagagcccccgcttctgcccggacacatgggcttctcgggggacttccagtccttcgtcaaagactgccttactaaagatcacaggaagagaccaaagtataataagctacttgaacacagcttcatcaagcgctacgagacgctggaggtggacgtggcgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccaggggagacctgggacctggacggccacctaggactgaggacagagagtggggggtgccc

SEQ ID NO: 31457 - DNA, 1286 bp, Homo sapiens
  misc_feature (1)..(1): n is a, c, g, or t
  misc_feature (3)..(4): n is a, c, g, or t
  misc_feature (970)..(970): n is a, c, g, or t
  misc_feature (972)..(972): n is a, c, g, or t
  misc_feature (974)..(975): n is a, c, g, or t
  misc_feature (978)..(978): n is a, c, g, or t
  misc_feature (1012)..(1012): n is a, c, g, or t
nanncgcaggcggtgtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccaccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccagcgctaccaggcagaaatcaacgacctggagaacttgggcgagatgggcagcggcacctgcggccaggtgtggaagatgcgcttccggaagaccggccacgtcattgccgttaagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcagtgagtgggggccccccagcgggggagggggtggggtcttntnannatntttattgtggttcaatactttttgggaaaacttnataattttaacaggacttttttttttttgccactagtttttttttactgctttagggcatgatccacatgacaaactatgattaatgccatccatcttcctggccctccttagtacttaaaatattcagacttttaattttttttttttttttttttaaagatggagtctcatgatatttcccaggctgaagtggctttttacaggtgcaatcttataacaccacatcctttgactcctgaacttaatcaattctcctgccttagcctttttaa

SEQ ID NO: 31458 - DNA, 1039 bp, Homo sapiens
  misc_feature (1)..(1): n is a, c, g, or t
  misc_feature (3)..(4): n is a, c, g, or t
nanncgcaggcggtgtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccaccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccagcgctaccaggcagaaatcaacgacctggagaacttgggcgagatgggcagcggcacctgcggccaggtgtggaagatgcgcttccggaagaccggccacgtcattgccgttaagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcacccgagcgcattgaccccccagaccccaccaagccggactatgacatccgggccgacgtatggagcctgggcatctcgttggtgagttgggccctcccctgttctccagc

SEQ ID NO: 31459 - DNA, 1679 bp, Homo sapiens
  misc_feature (1)..(1): n is a, c, g, or t
  misc_feature (3)..(4): n is a, c, g, or t
nanncgcaggcggtgtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccaccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccagcgctaccaggcagaaatcaacgacctggagaacttgggcgagatgggcagcggcacctgcggccaggtgtggaagatgcgcttccggaagaccggccacgtcattgccgttaaggtgagccttggcggctaccccggctgcgccccacaccccaggccggtgctgaggctccctcctgtccctgcctgtgcagcaaatgcggcgctccgggaacaaggaggagaacaagcgcatcctcatggacctggatgtggtgctgaagagccacgactgcccctacatcgtgcagtgctttgggacgttcatcaccaacgtgagtacctggccgcgccctgcagcgtctcctcctccctcacccctgccccttcctagggagcagagcctctggggggtgggccggaagacacagctcccccgggtgcccctctccctgcagacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcacccgagcgcattgaccccccagaccccaccaagccggactatgacatccgggccgacgtatggagcctgggcatctcgttggtggagctggcaacaggacagtttccctacaagaactgcaagacggactttgaggtcctcaccaaagtcctacaggaagagcccccgcttctgcccggacacatgggcttctcgggggacttccagtccttcgtcaaagactgccttactaaagatcacaggaagagaccaaagtataataagctacttgaacacagcttcatcaagcgctacgagacgctggaggtggacgtggcgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccaggggagacctgggacctggacggccacctaggactgaggacagagagtggggggtgccc

SEQ ID NO: 31460 - DNA, 281 bp, Homo sapiens
ggttagagaagtgtttagcgatggcgatgatgatgacaatgatcacaatgatgactggcaccacattttccacatagaaatgtgtagacactttgctaagagctttaccctcatcgcttccccaaaccctcaccacagccccctgcgacaggcacgatcatcgcgtgcattttatagacaaggaaattgaacctcggagaggccagatcacatgcccatcggtacctaccagacttcagaacttgcagccggatccaagctctctgtggccaggccacagg

SEQ ID NO: 31461 - DNA, 751 bp, Homo sapiens
ttctgaagaaagagtttcactctgtcgcccggcccgcagtgcagcgatgccatcacagctcactgcagcctccagctcctgggctcaggcgatcctcctgcctcggcctcccgaaatgctgagaccacaggcatgagtcactgcacccggcctctttttcttttatgagatataattcgcagaccataaaattccgccttaatgggaggctcatctgggcccgggacattgaggctgcaatgagctatgatggcacccctgcactccagcctgggccacagaccaagaccctgtctcaaaaacaagaaagaggagagaagccccatccccatcagctgtcacttcctgtcccctccccagtcagcgtcactccctatcccctccccagctctggcacccacgcatcccctcctgtctctctggattggcctgtcctggacatttcatagaaatgagatcacacggccgggtgcggtggctcacacctgtaatcccggcactttgggaggccgaggcgggtggatcacctgaggtcaggagttcgagaccagcctggccaacatggagaacccccgtctctgctaaaaatacaaaaattagctggacgtggtggcggacgcctgtaatcccagatactttggaggctgaagcaggagaatcacttgaacccaggaggcggaggttgcagtgagccgagatcgcgccactgctctccagcctgtgcgacaagagtgaaactctgtctcaaaaa

SEQ ID NO: 31462 - DNA, 480 bp, Homo sapiens
gaggcagcgcttgcagtaagccgagattgcgccactgcactccggcctggacaagagagcgagactccatctcaaaaaaaaaaggaaggggacagaaaactggaatagaaaattattaaggttcattcctgctctaaaatcacaaatcatcatattttctaaagcatttaaaaatggtatgcataaataattagaggcttaggttctaaactaattataattaaagttcattgaaggcagaggtagagtgtcattataaaagttttatgaattgtcttaatactgagtgaacactcaaattctaatggaatgaattttgcctgaattacacttttaaagcaaagtttccatgtgaattattatggagccatcattgattacctatttgattttgcaagtttattcatttgtagaacgggaataaaatacaccttacaaagttgtaagaataaatgaaataaagttctgaaatataagaat

SEQ ID NO: 31463 - DNA, 348 bp, Homo sapiens
tgaatcatagatggagaaacccgggctgaaaacagttaagtcccttcctcaagggcacgtagcaagtatgtgcaagtacgtggcagagctgggctataaacccaagttatcagttcccttttggaagtttttattttatcttcaagctcttttggtgcttgattttacttaatatttttcttggtgaagtcagtgttatttaatttggatagccaagtagtcaaaatatattctgttattgtcatcaagaaatgtctcagtcccctcttgggcatggtgctatattgttatgtatcataagagtgaaaaacagaaacagaagcagcaagcatatgggtttttaactaa

SEQ ID NO: 31464 - DNA, 309 bp, Homo sapiens
aaaaagaacaattattatgtatcaggtgctggattgagagttagggatacattagttaaagagctccaaagtaggagatagtgtatactatataaatatttatggaatttaatgactttattaatctagcaatagtatatattttttaatgttctttttgtttttctttgttgttgttgtttttgagacagagtctccctctgtcacctatgctgaagtgcagtgacgtgatctcagctcaccgcaacctctgcctctgggtttaaacaattctcgtgcctcagtctcctgagtagctgggactgcaga

SEQ ID NO: 31465 - DNA, 96 bp, Homo sapiens
ttttatttttaatgtctactgtagggaataataaatctacaaaaggagtatctgttctctctccttccaacaatactcttgcaattttgtttcatt

SEQ ID NO: 31466 - DNA, 258 bp, Homo sapiens
tgtgttttcattctaatacattggtagtaaatgcttggagaagaattaatattgttaccattaataacatagcttctaactttaacaaagtaggggtaaatcaacataaatttccttaactttcttttattattaaaataaaattaagtctcttaagcttcgtttaaagttaggtaaatgtcctgttgttgtagaacttctgaagattatagtagactagtgaagtcccatcatatacacatttaatgtatgtcctca

SEQ ID NO: 31467 - DNA, 586 bp, Homo sapiens
aattttcttccctactccccaactggcaaacaaatctttcttttttctctactcctttatttccataaaaatctcagctctctctccgtggaaaaatatgtcatgattattccttttgtctaacagtgtttattatattttaatctgtactcatttaaaagctacacagtagtcctacatcatttcatgcaaataaatgtttaatccttaacaggaatgtcagctccttgaggacagagccctgatttccattttgtcttccttaaaaaatctgttatgttgtgtgtctattgcggtagagaatccaaagagggtagccatggtctagaaaaatgtctgagtttaattagtgtttgactaaatagtggtcatccatcttcggtttgaatcatttcctttaatttatgtgaagagaagaaatcattcctgtgttaataaccattgaactcctaattttttaaagttgtgctttattgcattaagccactttgcatcaggaaaatgggtgtctttaatcgaatgtgattagaaatgctgctggcaatcagcagattttacttcctggttaatatcataggaggaggag

SEQ ID NO: 31468 - DNA, 456 bp, Homo sapiens
gtgtcagaattttctttccttttttaaggctgaataatattccactgtatggatatattacatcgtgtttatcccttcatctggtgatggacacttgagttgcttccactcactcccagatgttttttcccctctctgatcctcaaggaatagaaaatgcccagccttcatttttacattttacaggtagtggagctttaaaaaagagagtactttgggaggcacagataggagcatcacttgagcccaagagtttgagaccagcctgagcaacatagtaagacccagtctctacaaaaatcagctgggtgtggtggtgcgcacctgtagtctgagctactcaggaggctgaggtgggaggattgcttgagcccaggaggctcaggctgcagtgagctatgatcgtgccactgcactctagcctaggtgataggtgagaccctgtcttaaaaaaat

SEQ ID NO: 31469 - DNA, 1495 bp, Homo sapiens
ttggaacttcttggtattgcagaatatactcttttgaaactgacacactgtactaagtttttagactcctagaccaaaatttgctccccagggaacatttgtcaatgtctggagacattttcggttctcacacctggggagggtgtgatactggcatctagtgggtagaggccagagatgctgctacatattcgataatacaaaggaaagctgccacaacaaagaatgatctggcccaaattgtcacctgtgctgaggttgagacatcctgttttaaatgattcaaggtttttcaccttagtgtaatcttgcaatcccgtggtcatgctgctgatgtcttcagtttgtgtgacccagtaagctcaagaaagtgcctatggcagttgacatccgtggacttaatacacatttactaaattttgtaataagccatgctattgatagaagataatataaacttgtattcagtagtttggaggtacgtgtttgtggactgactgaagcatttttcagggaatgtatatgggtattggagacaattgtcatttagctattgtaataatgttataaaggatttcctgtcctcttcaagtagctctgggaaaatgtgtctgtacacataccatgcttatgaactaaaaatacttttaactagattgaaaaggttaaagaaatgtacatacacatatatacatacatatgcacacacaagaatgtgatccactgctggtgcagcatgtaaatacgaacacattcctgatggttgctatatatggatgagtagttgtagtaagttcacttcacctcaactaaaaaataaaagtgatgtttcatagaacttagtcttccacttgatctggaccctcatcttgaaacctcatatgataaaatggagaacttcttttaaacataagaaggtagtaatcacctgtggtcccagttacggggctggggcgagagaatctcttgagtccaggagttcgaggctgcaatgacctatgattgtgcctgggcaatagagtgaaaccccatctctttaaagaaaaaaaagaaaaagtgtgatagtcttggtttgtatttcctcatcattaaatatttgatttaatggtaagaaagttattgtgagcactttcacaggtcctccctcaggctgtggggccaggatttggtagctggtgctgagagaaaacctttgttggcatccttgccctgggactgtgccagtggcagctgtcattcaatgggacaatttcttctgattaaaaaaaaaggttattgtggttaaaaaaagattagttttctcaagttcattagtttcatttagtgccgttcacaattgttcgttttctagtattctttcattaacagagcattctgttttctttctaagcaggctgtctgcataaccttctgtgaactatgtgctgatgtcttgtaggcaattatatttgacaagattattctgtatctgtgattgactccttgaggaatagat

SEQ ID NO: 31470 - DNA, 352 bp, Homo sapiens
gaagaaagaaagaaagagagaaagagagagagaaagaaagaagaaagaaagagaaagaaagaaacaaagaaacaaagaaggaaagaaagaaagaaagaaagaaagaaagaaagaaagaaagaaagaaagaaagaaagaaagaaagaaaaagagaaagaaagaaaaaaaaaggaaggaagaatactttcaatatgccggtttcttaattttactatctggtactactgaatcaaaaattggtggtggcaattagattttcaggtggggcaacaatattttatgccactaagtttctggaattaccactaatttagagtgaagaatacagctcaactcaggaatgtggaaagtc

SEQ ID NO: 31471 - DNA, 345 bp, Homo sapiens
ctccttgatcaatcaaagggcatgaattttaatatttaaaaaatgtctttgtgaattaagcttaaaaaatcctacccaaacaatagcactctccaaaagtgaatgattttgccaccatcaaatgatcttcaggattctcccctgtcttgtggtgaggtttagtttcctaagaccaaaatgagattaagccttgctgaactttatctgagttttaataatcatagaattattacaaactctgaaagagtttgagattataagagtatgctgttttcacaacataaaagccaggtggatggacgcagggtgtatccaaggctgcacagtttgggaagttcccccaga

SEQ ID NO: 31472 - DNA, 408 bp, Homo sapiens
tggaaggtgattgtaccaagtttctgttctctctgagcccagtgtcctcttacctctgctctcttctcttcctgcagatctgcttctcaccttctcaaaggttaaggtttcccacagcacttgagtttgcacagcatcacttcaagagtctgtcctagagtgactcgcttttctcaattccaaattccccagagaaggaccctgattaccctgtcttgggcagcgtccacacccagaaatgagattagagacattcagtactttgaaaactggagaataaatgaatcccaacatgacatgactgagtgaaggtgcagccagcagtgatggaggactctggagaaacttaggagtaaataagtcccttggtgtgctgagatccatcctaaagactgaattctgaagtca

SEQ ID NO: 31473 - DNA, 468 bp, Homo sapiens
tgacgttttaaccaaaatatgtttcttctttatttgtggataaaagtctggagggtttttctgttttgtttttctacgaatattatttggaggcataactaggacctggggaaacgcttggctcctcttcgagccccgagggtgcaggttgggcagggcgggctccggtgggccgcacacccatcacccgtactagcgtgaggttgtcgaagagaaaatctcacgtttcgcatcctcaaatttccggatctgaaaccctatgcaagcagcaaccgcgggagagcgaacagcggcgggatgagcattcacaaggctgagcattcacagggctgcggggaaggcgggagtaacagctagcagcataccgcggccccgccccgcagaggccctgccccgcccccgccagagtacagagtacgagctccgacttggtctcgtccgcggtcgtccccacccctcagcgcgctg

SEQ ID NO: 31474 - DNA, 468 bp, Homo sapiens
catacagtgaaatatcagtttgcaaaaaaatgaagtactaatacatgttacaacatggatgaacctcaataactggactcaaaagatcacaaaaaggacacaaagacagaaagaaggttagtggtttccaggaactcagagaagtggggaatggtaggtgactgctaatagatacagagtttcttttggggaaatattctggaattagtggtgatgattgtacaaccataacctctgagttgtgctctggaagggcgaattttacaatgtaaattctatctcaacagagtagtataaccagcccccatggaatcaccatacagcttcaaatattaattcagattggtactgtgtcatttatatccttatgtacttcccctccctttgtattcatttgaagcataaccgagacatcatatcatgtcatctgttaatatttcagtaaatactctaaaggataaggacttt

SEQ ID NO: 31475 - DNA, 590 bp, Homo sapiens
aggggtgtttagtactgattggattgatgatgaccaagaaggaggaaaggtggggtgacaggagtaaacccttttctttaccccttccttttgacctttgtcccattgccttcatgtaagggtcactgattcttcataataatttaaatggaataaaatcttatttaaacctttttttattaattcaaataaagccgtttttttatgcctttattttttccctgtctttacaaaaattaaaaaattagctgggtgtgatggtgcccaactgtagtcgtagctacttgggaggattagttgagctcaggaggtcaaggctgcagtgagccatgtttgtgtcactgtactacagcctgggtaacagaataaaagcctgtctcaaaaaaaaaaaaaaaaaaaaagtatggatagaagaaagtagatcagagaaagtctttttcaaaataatgtttatgttttctaattttaagcatattctcagttttttaataatatagaacagtggaaaaaatttaaatgccacgtacgtgcatatctaccacccagaaaccgcttctattaatagtttggtgattttctttaaaaaaaaa

SEQ ID NO: 31476 - DNA, 646 bp, Homo sapiens
  misc_feature (318)..(318): n is a, c, g, or t
tggcctcaagcagtcctcctgccttggtctcccaaagctctgggattacaggcatgagcaagtacactcggcctaatttcacctctcttgatgaacatttagatgatttccaatatttgctgcaatgaaacaatttgtttatgtgtttctctacccataagtgtaagtcatctacacatctcactcctttctaaggttcttatatagtgtatacgttgagtatatttgaggaaatatttattaagtttgtaccatgggacaatattcgatagttcatcatattgatgccagcgttttacttcaacctagtggcttatncctaggattgtttccttgcctagaaacaaggtcaggtaattaaaaattcttttttgtcccttttgttggtggagaatggggtcttgctatgttgcccaggcaggtcttggactcctgggcttaagctatcctcctgcctctaccttgttaagtgctgggattataggactgagccgccatggccagacttgttttttcttgttttgagacacagtcctactctgttgcccaagctggagtgcagtagtgtgacctcagctcactgcagactctgcctcccaggctctgcctcccacctcagcctcccaagtagtgtgcatgccaccac

SEQ ID NO: 31477 - DNA, 117 bp, Homo sapiens
aggaatgagttagaactggatctgaagtcctcaggtaataggcatggctatgactgggtgactttaagcattgttgcttctcaacttgctttgtatcctcagcagtcaaaccaggtg

SEQ ID NO: 31478 - DNA, 1301 bp, Homo sapiens
ggaggaggcaggaagagaaaaactaaaataagatcagtagcgccatctagtgagaaatcctagcactatcaaatccaagtaatcctctaccctgcccagatactttaattaaactatttctaaactttataaagctgaactgtcagcaacagaatgtcgaatttgagtcatcttccattttatacaccaacattttttctcaatgccagtctatctccagtgaagacaaagctaaagtgttgaatgaatacatcaagaaatatcatacattttgtgaggagttaatgggcctgaatctattttctttattctgtacaacctcccatcatcagccaaaatctgcaaatagctcgatttttgaagagaagatgaggataagtaggaggttgtaatatccacttaaagtaactgttcagcatgaatttaacacagcaattgagtagttttgagtcccccaggaagatttcttgtcatgatgaaaacagtctttcacctagctatcagatccttcttccattatgattgttggaaaaccagcttatgtaaggatctaccctttgttcaatgcctactaaatactagtattttattaggtaatgtatacatattttatttgtcaggcctctgagcccaagctaagccatcatatctcctgtgacctgcacgtatacatccagatggcctgaagtaactgaggaatcacaaaagaagtgaaaatgccctgttcctgccttaactgatgacattaccttgtgaaattccttctcctggctcatcctggctcaaaagctcccccactgagcaccttgtgactcccacccctgccagccagagaacaaccccctttgactgtaattttccattacccaaatcctataaaacagctccaccccatctcccttcattgactctctttttgaactcagcctgcctgtacccaggtgataaaaagctttattgctcacacaaagactgtttggtggtctcttcacaaggacgcaagtgaaattattatttaagccttccaacatatctaatatctgaacctcaactcttcatcttactagctaaatgacatcaggggaacaacttattaacctctctaagtctgtttattcacctgtgggtaataccattaacatctccttaatagatttgtggtaataattgaatgaggtcttcagtgtagagagctaaacactatgcccatttaaaaagtgattgctgctgctctatcttcccagcccagggggttcttggacattctccccgtgatgagtgcccctcttctgaagtggggg

SEQ ID NO: 31479 - DNA, 736 bp, Homo sapiens
  misc_feature (28)..(28): n is a, c, g, or t
  misc_feature (32)..(32): n is a, c, g, or t
  misc_feature (34)..(34): n is a, c, g, or t
  misc_feature (37)..(37): n is a, c, g, or t
ccttggccagctcacgcaatgtaacggnctgnanaanacaggggaacaggaagcagcctctgagcccaagctaagccatcatatctcctgtgacctgcacgtatacatccagatggcctgaagtaactgaggaatcacaaaagaagtgaaaatgccctgttcctgccttaactgatgacattaccttgtgaaattccttctcctggctcatcctggctcaaaagctcccccactgagcaccttgtgactcccacccctgccagccagagaacaaccccctttgactgtaattttccattacccaaatcctataaaacagctccaccccatctcccttcattgactctctttttgaactcagcctgcctgtacccaggtgataaaaagctttattgctcacacaaagactgtttggtggtctcttcacaaggacgcaagtgaaattattatttaagccttccaacatatctaatatctgaacctcaactcttcatcttactagctaaatgacatcaggggaacaacttattaacctctctaagtctgtttattcacctgtgggtaataccattaacatctccttaatagatttgtggtaataattgaatgaggtcttcagtgtagagagctaaacactatgcccatttaaaaagtgattgctgctgctctatcttcccagcccagggggttcttggacattctccccgtgatgagtgcccctcttctgaagtggggg

SEQ ID NO: 31480 - DNA, 444 bp, Homo sapiens
gaaaaataattaaatgcttaccctgcttttcctagataaactgaaacttcaggtaaccaaaaagttgataaagggaaaattcttgtttttgaaagcatttcagctactaagtcaagaagaaatgataatatttgcctatccccatattataacccttattgaaatgatagctcatagatgactgtcagtggttgacttcacagtaagagagacagccggactttgtgctttctgatcaaaatacataacaccatctaggaagtaaaatatttcctttttttttttttttttcttttgagacagagtctggctctgtcgcctagactggagtacaatggtgtgatctctgctcactgcaacccctgcctcaagaattcaagcaattcttctgcctcagcctcccgagtagctgagattagaggcatgtaccactacacctggcta

SEQ ID NO: 31481 - DNA, 261 bp, Homo sapiens
tatgagtaaaaagcaactgactaaaaaaagcgatgaagcacatttgcaaacaaacaaattgattctctataagtgaaaaatatatttaaaatgcaatgcatagttatagcaacagaaagagaattagtaaatttttagtgatctatataattagcaagaatacagcaaagtatcaaagacatggaaaatatggtagagagatcaagaggcacgaaggatagaatgagaagaggtgagagcaaataggtacaggagattatc

SEQ ID NO: 31482 - DNA, 345 bp, Homo sapiens
aattaataggagcagatccagaaatgacaaagataatagaattagtggacagagacattaaaacagttattttgaccgttattttatgcaatcaagaaaacatgttagagacatgaaaggtgtaaacagatccaaatcaaactttcagaagtaaaactacaatgtctgacatgaaaaatgcactggatgggattaacagcagaagtcattgctgaaaatttccacatttgatgaaaaatacacacatccaagaagctcaacaaacccggagcacaagaaatatgaagaaaattataagatacattataatgaaatcacttaaaatcagtggtaaagaaaaaaatc

SEQ ID NO: 31483 - DNA, 528 bp, Homo sapiens
cgtgggagaacaactaaactctttatcagctggctgttgcctgttgttgagggcagacgtgaggttgacctccctaaagtgaaccagtgaatttgttaagttcattatgtcatttccccctcagatagtgccaccaaagtgacaagataataaaaaaaaaacctgaacaagtccataaagtcacaaatgggaacaagctgtggaaagcttgttcccaccttccttctgaccagcatctgtggccctcccctgctctctccagtaatccagcagaagcctcttaacgccagctctcaaatatgccaagactgccaactaaccatagggctggaaatgaaggaggtctaaatgatatgacttctattagggtcaatcatcatacccttaattctttgagaaagtttaagggaatagcatggcataaataatattttaaattcctaaagagaaattatattttataaaagaatgaagaaatgggtgcagttcagcatgcacacagcactcacatagcgcacacgcaagccc

SEQ ID NO: 31484 - DNA, 382 bp, Homo sapiens
taagcttcgtcagagtcaagattctgttttgttccttgccctatctctggtgttgagaactatgccaggcacatagtagatgcgtagtaaatatttgttgaataaataaaaagcagtgcatgcttttaaattatataagcttggcctcatccctgtgtggaccctgaataagccacttcattgctctgaagctgtaaaatagaaatcgaaatccctgcctcttcagttaaggcttaaggtatcccaaagccaagggtcagggggagaaggatgaaaagttaatattgtagtgtacaaatcatacagtcagtccttgaatacttagtttagctttagaatctgcagtttgttacaactgtgtctgcaaggagaaacttgcaga

SEQ ID NO: 31485 - DNA, 1243 bp, Homo sapiens
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacagtactatgccaatcagaatggctcaaataccaagggaagtgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaaaaaa

SEQ ID NO: 31486 - DNA, 1093 bp, Homo sapiens
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtactatgccaatcagaatggctcaaataccaagggaagtgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaaaaaa

SEQ ID NO: 31487 - DNA, 840 bp, Homo sapiens
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaaaaaa

SEQ ID NO: 31488 - DNA, 1262 bp, Homo sapiens
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacagtactatgccaatcagaatggctcaaataccaagggaagtgttattggttctctaatgagatgaaaagctggagtgacagttatgtgtattgtttggaaagaaaatctcatctactaatcatacatgaccaacttgaaatgtccctcgtccacattttaggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaaaaaa

SEQ ID NO: 31489 - DNA, 366 bp, Homo sapiens
atcccattatgtctaggttttgcttcatctcattaaattaattgtcttaattcccaaggaccattatttgtgttttggccatcttttgtgtctggacaatttgctataagtgattttattgtagctcaactcttatttatacaacatgtaagtattgttcttatggccaattttcagagatgcatatgtaatttaatttcattttgttttctacatttctctgtagtactatgccaatcagaatggctcaaataccaagggaagtgttattggttctctaatgagatgaaaagctggagtgacagttatgtgtattgtttggaaagaaaatctcatctactaatcatacatgaccaacttgaaatg

SEQ ID NO: 31490 - DNA, 452 bp, Homo sapiens
acagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaa

SEQ ID NO: 31491 - DNA, 953 bp, Homo sapiens
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttgggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaaaaaa

SEQ ID NO: 31492 - DNA, 413 bp, Homo sapiens
tagtatcatccattacgcatttcaccaattgtgccaaaaatgcccatttacagttagtttgttcaaatcaaaatccaaacaaggtccacacatcacttttggttactatgtctgtacatattatggtttgattatttggttattatatctataacagtcccctcttcttttttctggacatttatttatcagaaaaacactttattttatgttttataaccaggttgtcacaccattttccaattctaaagcaatatcataactatcataactcattcaacatttatttaactactgtataatgaacaattactatgtacaggacagtgtactactaggtgctgagtgtgattcaaagatgtctgtaaatcatggtccctacccccaagactttaccatctgaggaaaaggaa

SEQ ID NO: 31493 - DNA, 1317 bp, Homo sapiens
ttttttgtgagaatcgattgaaatagtatatgaagtggtttgaaaataggtacaaactattgacatttcaatgtcagagagtgatacctgtagtagtataggcaaaggtccaaccccatcgaaaggcttaaacatttaccttttctgaaaaactattgaaatataaagagagtccccagtcacaggggcaacttctgtaaccaaatccagatctgaggaaactcctgtaaccccatttggggtttctttctaagccaatagggttacaggttggtacagtgacacattgagaatggggctacaaatacttttcccaccatctaggatgaaatacacgaaatcctgttgaaatcttggtttttatgcctttgctcatcagaataaacgtaaatgctgaaaaacaaataacctcctgatccactgtcttgcctcctggtgagaaatgattctatcccctgtttattgggaaatttccaaagttgttcatcacttaaatgccgtattcaaagggaacatggaaggatgaagcggagaaagtgccttcgagacattcacacatttctctggactcagtctgttaacatatcagggagcttgtcagatcacacctttttgccttggaaatcctacagatttcctgtacgccttcatatctgattcttccctaaaacctttgggtatgatttcctccctggtcttgataatgtcctgcagtctgtgttttataattattctttgtatttattgaatctagactttaagttattcagagatcagaccagaaccttagagtttctaaactgtatgtggatattaaataatattaataatgaaagagctaccaaaatagtctatattgtgtgaacaatctcttgggatattagacgtgtttaaagaccagtgttgctgctatttttaatattttggttaatttaagtgaaatgtacatattttaatttgaagatttatcttgcccatcagaatgtgaagatatacttgcatatattttgacatatttcatggaaaataaaaatgataatccactttgtgagtgtaagtgaatgtattcatatgtatgttattataaatgatttttgtttgcactgatgatgaaatgagagttttgggggctttttatacatttatatcgactggtctctaaatctcctattttgttttcttatcatttttgaaatacagttcccattacatgagttttaaatagattggtgtttcattttgtattatgctactactagatgttgattctctggtattgtaaaataaaatgtgctccaaaaacccaaaaacttggac

SEQ ID NO: 31494 - DNA, 290 bp, Homo sapiens
ctactactactaaattaacggccgctcgacgtgaatgtattcatatgtatgttattataaatgatttttgtttgcactgatgatgaaatgagagttttgggggctttttatacatttatatcgactggtctctaaatctcctattttgttttcttatcatttttgaaatacagttcccattacatgagttttaaatagattggtgtttcattttgtattatgctactactagatgttgattctctggtattgtaaaataaaatgtgctccaaaaacccaaaaacttggac

SEQ ID NO: 31495 - DNA, 340 bp, Homo sapiens
tttatgtgtcatatagaattaatcataccttgcctatatattataatcaaattgtctgttaagcagataaatttagagaactgttatgctgcatggcatttaggtttacatgctgaggaagaaaaaaacttgaaatgattgtggctgggcacataacaatgaattttatggattaaaaaaaacagccaggtatggtggcacatctctgtagtcctcagctacttgggagaaggtgggaggattgcttgagccggagagtgaggctgcagttagctgcgatcatgccactgcactccagcctgggcaacaccctgacaccatcacaatgtatatgaaacat

SEQ ID NO: 31496 - DNA, 677 bp, Homo sapiens
aaaaaatgtatactacattataaaatgtgtcattttagaggaaaatgtagaaccttaaattcttattttatgaggacaacaaattaatttttaaaatgttttgaatttattggtagaagttagaaatatcaacagaaataaaaggaaataataaatacatgcatagtgattaagaatacagggaaagaaaagtcaagaaatatggccaaaagtttgttagttgttgtaggagccatacaataacaaaactctggagaaatggcttgataaaattaagagaagaaacaagtatgccatctcaggaatcaaaataggaaataattatacatcaggtgtcaagaattttttttgttttttggaaaggatctgttggtaattattttaggtttttgggctatatggtttgttgcaactaatcaattctattgttgtggcataaattgacagtatgtcaatgaatgagcatgacagtgttccagtaatactttatttataaatactgtctggcttatttgccacagtttattgagttttgttataaataatacaaatatcaagaaggtaaattagtatagtatgaaaacgtttaattcaataaatttggaaatatatgtaaaatgtgtacaattacttgaaacatgcatttttccaaaagtaacctaaagtgaaaagaaaaa

SEQ ID NO: 31497 - DNA, 337 bp, Homo sapiens
agaggaagtgaaggaagaggtgccagcagggagctgggctgctggctgtgcaggaggtgccaggaagcctgggatcacgctgtgggccccgtgggctgagggcctcccactcactgctgttttgttcagctccagggttactgatgggcttggcagagctgagaaggctggacctaactccctagctcaaagctggcagggacagagacccccaacttagcatggcttacccaggaacttattgtgggggacaaaacccacgtgatccaagttatgagtttttttgttgttaagccagggtcttgctctggagtgcagtggcgcaatctccacttac

SEQ ID NO: 31498 - DNA, 325 bp, Homo sapiens
tatgaggcagcaatgggttgattgtttgtgtctggaaggcagtggggatgtaggggaatcataagtattaataaaatgtgctggtcgggagcagtggctcccaaagtgtaattccagcactttgggaggccgagacgggcggatcgcttgagctcttgagttccagaccaccctgggcaacatggcgaaaccccgtctctacgaaaaaattagccgggtgtggtggagcacgcctgttatcccagctactcaggaggctgaggtgggagaatcacctgagcccgggaggtagaggttgcagtgagtggagatcgtgtcaccacac

SEQ ID NO: 31499 - DNA, 410 bp, Homo sapiens
acagttacttgagttatttgttattattatccctattttacaagtgaataactaattgagacacagattttttttaacttccccagtcacattattttaaatgattgatagacccatggctgctctaagtacccctcccttcatgttcacacgcatgcttgttgatctttggaacttctttactaataattacaattgaccactgaacaatgaggggcaagggggctggccccacacacaattaaatattcatatgtaacttttgactctccaaaaatttaacttctaatagcctattgttgactggaagccttactgataacataaacagttgatttacatatattttatatattatatgtattatatactgtattctcacaataaaaaaagctagagaaaagaaaatt

SEQ ID NO: 31500 - DNA, 467 bp, Homo sapiens
tactcaccagttgagcatcccaaatctgaaaatccaaaatgctctgatgagcatttcctttgagtgtcatgtcggtgctcaaaagtttccaattttggagcatttagattttggatttttgggctagggatcctcagcctgtagcagttcctgtgactataacatcaataaaatcacagtaccatgatctgtttctacactgaacacttctgacatcagatgtgtcagagttttccccacaccagcaaccagttctctgattctctggtcaccaactgggtctccagtgatcagttaaattctgacactaacaacctgaagttagcacagaccccacaagttaagggctcagtctcacaagactgccccaagatacccactgacctgctataaatcaagttcccaccacctcctcctcagggtcagtcatttgctagaatggcccacagaacttagaacactcttta

SEQ ID NO: 31501 - DNA, 487 bp, Homo sapiens
ctccaagagcccaactggggctccgcatgtgctgtggggcttggtttgggaaatcccaagctctgcaaaccttctgcccttaaggaaaccaccagaaggttttgatagctggggcatgaaaggaaggaagggtagcccttttttagttcagggcactggggacaaaagatcctgagaagccacggcctggccatgtcctgttctgcgagaaagcaagcctcaccagcacttgcagggagacggcccaggttgggtgaacaccgaaagccatgctgtccaccctgtcttcactgtcaataggagcaatgaatcgatgccagactcagtgacacaggagtctctccagacaagcgtggctatctaagggacaggtctgggggccatcctcgagacccaagggggtggcacttaggagctggccctgctgtcctctccaagacccaccagctccatgaagccacagcctccctccaccacccccattccg

SEQ ID NO: 31502 - DNA, 696 bp, Homo sapiens
gatatacctaatgttaaatgacgagttaacaggtgcagcacaccaacatggcactaacctgcacgtgtgcacatgtaccctaaaacttaaagtataattttaaaaaaaaagaaaaagttgttagattttaaaattattttaggatattttcttataagagaatgcacttatttttctttgagattgcagctattttcgtttgatctagaatcttctcattcttttgatttttaattttattgttagtagattataaagaatgggatattagagatttttctttaaaaatgaacctatatacattttatttatttattttcttaaagatagggtctcactctgttgtccagctggagtgtaatggcagtcatagctcattacagcttcaaattgctgggttccaggggatcctcctacctcagcctcctgagtagctgggattacaggtgcaagccaccacacccagctgattttcaattttttggtagagatggagtctcactatattgcccagactggtctcgaactcctggcctcaagtgatccccattggcttcccaacgtgctaggattacaagcatgagacaggcttcctttttttccttttttttttaaaagcagttatctgatatccatcaccttgtttacttgaccctgcttttaaaaaaataagtatataaaagtaaatacgaatta

SEQ ID NO: 31503 - DNA, 355 bp, Homo sapiens
  misc_feature (319)..(319): n is a, c, g, or t
  misc_feature (336)..(336): n is a, c, g, or t
  misc_feature (348)..(348): n is a, c, g, or t
gacttttcacatgtagaagaattacttctcattcttcctgttgaaattactctcaaatcttttctgacagagttgcaaacacactgacagctcccgaatgatctgatacaggatccttaataggcatggaagtgttcgccagacaaaaatatttgaggaacatgacaataatgacactgctaatggcttgtagtttcccgtgatactaatgaggacaggctagtttattaggtgttttgttctcttttttctatctcctccccatgcccttctggggcagaaggtgttactctttcacagtccttgcttcagggaaacngggttgaggggccaccnttggtcccggcntgtgtgg

SEQ ID NO: 31504 - DNA, 474 bp, Homo sapiens
ggaaccctgcaattaattgtcattgtctttcctggtgttgactggcagcactggggttgatcagatgcctagcacgcttcccctagctctatcaaaacctgcatatgaacagaaaatgcccttagcctgtgaatagtcagctaacagcttgtgaacttggggaccagtaacctccaggcttggtatttctcagcctgcccccaccctttttcctattgttaatttacttcttactctgagtaccacattgttcatataggaattgtctgtgaagtttacagaaactgtctactctaatgatgtcctctaataggtcagactctcttacttgggcccctttgttttatgttcatagttaatgtgccagcagcctggaggggctctggaataacagattccatcttagagatagccttaaagatgtgttttcattgatgagtgtttaatggagggtctgctggcgaatgacttggg

SEQ ID NO: 31505 - DNA, 796 bp, Homo sapiens
cttgttttatgtgaatatttattatcggcttctaaagttctgtaaataaaaagcttcaaaattttgttttgtaaagctttctgaagtagaggtatctagtctgatagatgatcttataaggtccattaaagcaggaaaaggacatttaattgagaacctactttcaccgcaccctattttccacctccaaaagagtttaaatcttttaaaatactcccataaataaaataccatttacattataaagtattgtgggaaaaacagtcttcacatgagtttacatttgttcataataaacccaccccaaattacctcccaattctgtaggttggtgatttaggctcagcttagccaagatgtttgggtgacctggagaaggttcagctgatcttgactagacttggtcatgccagctggtatgtgtcccttggctgtgattccttgtctctactccacatccttcatactccagcgagccagcacaggcttgtccacatggtggtggtaacggggcatcgagggtgcaagtggaagtgtacaaagacttttgaggccctggagtcaacagtgttatttctgctgcattccgttagtcaaagcgagactcaagggctgaagaaatggactctgcatctgactggaggggctacaaaagattgtggccatgtttttcattctaccacagtcattaatttatttgatattaaaggtttctagagatcagtatctttttaaaattgaataattgaccaaaccagtattttgacagttagtgtagataagacatatcttatat

SEQ ID NO: 31506 - DNA, 445 bp, Homo sapiens
gggtaggccactcaggtggcaccaggtgctacttatgacaaacatgaccagtaaacagcgggggtgagtctgtgccatgcacacacctgccacttctgtggaggggcgttactgggcaaaagcccattgtgtgtcatcagaaggggcttaacaacagcggccctggttacggcagccagagagcagggctcatggtcaggcagaccaccgttttctgtctgcaaggaagctctctggtacctcagtttcattgtctggaacatgaggattctgttagtgtccgtctaacagaacggtgtgaagacaaactgatacggcaggaccgtctccagtgctgcatccaacaggcttgttttcccacaaaggactctaagacctcacctaggtgtcgtcagtgacagcaaagacaatggcagctcacaccagtgaggggtccacaggcccc

SEQ ID NO: 31507 - DNA, 433 bp, Homo sapiens
gttgtgctaagattgacactgggacacggtccactgggtcacacacttattttccatcctcaagatttaagtataatggactagaacttgttttgatttctcgatatttaccaccctcagtttatccctattcctaattcctaaaattatattttccttggtattaaaaaaaagacatgccagccaggcatggtggctcacacctgtaatcccagcactttgggaggccgaggcaggcggatcatctgaggtcaggagttcgagaccagcctagccaacatggtgaaaccctgtctctactaaaaatacaaaaaaattagtcaggaatgttggcgcatggctgtaatcccagctactcaggaggctgaggcaggagaactgcttgaacccgggaggcagtggttgcagttagctgggatcatgccattgcact

SEQ ID NO: 31508 - DNA, 484 bp, Homo sapiens
aaaaaaagccccttatataaaaagaagtaatgtcaaagtttgatgagctttacattggaaactcaaaagcttgcactctcattttggctcagatgccaatttgctgggtgcccctgtggtgagtcatgaaacctccttgggccgcaatttcatcatctctaaaaacagaaattatcatacaacctacctcctgggaggtgctgcacaagaagcagctgatggaagtttcaaaatccaatttgtggccgagcgcggtggttcacgcctgtaatcccagcactttgggaggccgaggcaggtggatcacctgaggtcgggagtttgagaccagcctgacatacatggagaaaccccgtctttaccaaaaatacaaaaattagctggggcgtggtggcaggcgcctgtaattccagctacttgggaggctgaggcaggagactcacttgaacccgggaggcggaggtttcagtgagccgagatcgtg

SEQ ID NO: 31509 - DNA, 278 bp, Homo sapiens
ttttctcctggcctctagccaccttcctgatgcaaagccaccatcctctgccctaagtcacagatggcttcctcactgcttctcctgcccactctggccccaccagtccaactatgcataacaaccagtgcccttcaaaaatgcacaccttgaccaggcacggtggctcacgcctgtaatcccagcactttgggaggccaaggtgggcagatcacttgaggtcaggagttggagaccagcctggccaacttggtgaaaccccgtctctactaaaaata

SEQ ID NO: 31510 - DNA, 1905 bp, Homo sapiens
  misc_feature (881)..(881): n is a, c, g, or t
  misc_feature (910)..(911): n is a, c, g, or t
aagatggcggcgctgaaggaggataggagctacgggctgtcgtgcgggcgggttagcgacggcagcaaggtgtcggtgttccacgtgaagctcaccgacagtgccctgagggccttcgagagctaccgcgccagacaggtctgggcagcgtcttcctgaacagcctgaagcagaaggtggtgaccctggcaagcagcgcagacgtgctgagcaccgtgcagtcggcctcccaggccatgctgcagagcggctggtccatgctgttgcccaccgctgagaagcaggcccgggcactctgctctcctgtcctgcagagtttcaggcaatgaagtgagcataagtccaggtcatcgattggtgattgatcttctggtgggcagcctgatggctgatggagggttggagtcagccttacacgcagccattactgcagagatccaggatacaaaaaaagaagcacggaaggaaaaagaaatttatgaacaggaagcaaatgcctcaacatttcatagaaggaggactccattggataaagaccttattaatacggggatctgtgagtcttctggcaaacagtgtttgcctctggttcagctcatacaacagcttcttaggtaaatcatattagctgtattgtattgtgttttatttatttacttttttgttttttgagacagagtttcgctcttgttgcccaggcccgagtgcagtggtgcgatcttgactcactgcaacctccgcctcccaggttcaagtaattcctctgcctcagcctctcgagcagctgggattacaggcatgcgccaccatgccccactaattttgtagttttattagagacagggtttcttcatgttggtcaggccggtcttgaactcccnacctcaggtggtccatccactttggcctnncaaaatgttgggattacaggcattagccaccacgcctggcctatttatttacttattaatggtgttttttttttgtttttttttttgagatggagtcttgctctatcgtccaggctggagtgcagtgtcacgatcttggctcactgcaacccccgcctcctgggttcaagctattctcctgcctcagcctcccgagtagctgggactacaggcgtctgcaaccacacctggctgatttttgtatttttagtagagatggggttttaccatattggtcaggctggtctcaaattcctgacgtcaggtgacccacctgccttggcctctcaaaatgttgggattacaggtgttagccactgtgcctggcctgtattgtattttaataggtgattattggttttcatattaagatagtgaaatctagcgcaaggatctcaaaaatttgtttgatgattgaaggaatattctgaaaattacctagtatagatgttaggataaagagcagacccttttcaatataggtgagaggagaagttggagggtgtgatgatactcaaaagtttttcactgaagagaaattggggcgtgcagtaaacatgtaaaaagattcttactaataagcaggtggatgcaaatgaaaatcatcatggaaggttatttttaaaactggttctatcattgcctcactttatatattacagagttatacatactactttgtaagataacttttcttttcaaaactgaagtcaatgtgatagaatggtgagcattattttggaaggccagactaggaggaggtgggaggaagaagtcagactcagcctgtgaacagacgctaaccttggcagaagccaaaacagtcagacagtgttgtctaaaaatgatcattcaagaagagcgaaacagcaaggtgatttgtgaaagagatttattagaaaatgaaacacatttatacctctgttcaataaaaatctgcttttcgtcaaactga

SEQ ID NO: 31511 - DNA, 224 bp, Homo sapiens
ttttttttttgcatatgcagtttgggttgagttttctgttgcacaaaaccaagaaagtcacacaaatactatatatctttgttttttttttttttgagacggagtctcgctctgttgcccaggctggagtgcagtggcgcgatctcggttcacgccattctcctgcctcagcctccggggtacctgggaccacagacacccaccaccacgcccagctaattttt

SEQ ID NO: 31512 - DNA, 531 bp, Homo sapiens
tccaggaatctcagccctttacttacaccataaacataaataaactctaaataaagtatagacataaatgtaaaagttaaacctatacactttttagaagaaaactgtcataaccttgaggtgggcaaagataagaaacaaaatatacatcataaaaaatcctgacaaatcaggcttcatcaaattaaaactttctgcctttggagagatagcactgcaattacaaaaaggcaagctatgatctagggaaaaaatttttagaaatacatgtctgaaaagacttaactatccaaaatatttaaataatactttgaaaattaacaagaaggcagacaattggattttttaaaattggcaaatatttgaacagacactttacaatagaagatacagaatagtcaatgagtgtaggataagatgttcattcaacagtattgttcaccagggaaatgcaaattaaaccactatgaagtacaactgtaatagctaatatcaaatataactgacaacaccaattgctgatgaggatga

SEQ ID NO: 31513 - DNA, 2527 bp, Homo sapiens
cagcggcggcccaggaggcagccggtgagcgcctgcgagcagagtggcgggggccgctgacaggtcccgcgcagcccagcccagcccagccacgcggctcacaggtggggtccaagagcagtttggagcaacccggcgctacggagaggggtggacggctctgcacgggcctcctgtctcccgctcgggcagagggactcggggggacctcgctccttggccgagagaacctgaactcgggcggagagaacgcgcccaggcgggcaaggggaccagagaaagccggggctggaagtcactgtcgctcgccactgtctggagcgcacggagcgcagaggcccggcagccgcgcgtgccctcccggggaccgagccagtgatgcaggatcgctgagcggagatccgcgccgagaagtctctcggggccggggctgagacgcacgccttcgacaccgctgccaagaccccgattccggcgactcttgcggggaaccgaggggccaaggctgccccaagctcaggacttgggcgagtctaagacgatggtttcttaagcacggacccgcgttccccttcccgccccctcgactggaggcagggatcctgcgcggggcccccgggattccgtttccccgcggagccccggccgctgcctcccgggacagttcgcacggccacaggggcgcacggcgatgtggcctccgtccagcgcgctggcccgccggggggatgctctggcacctgtcggggtccaggcctagcatggccggcgcgttgcccgacgtcgcctccggctaggatggcccctccgggcccggccagtgccctctccacctcggccgagccgctgtcccgcagcatcttccggaagttcttgctgatgctctgctccctgctcacgtccctttacgtcttctactgcctggccgagcgctgccagaccctgtccggccccgtcgtggggctgtccggcggcggcgaggaggcgggggcccctggtggcggcgtcctggccggaggcccgagggagctggcggtgtggccggcggcggcacagagaaagcgcctcctgcaactgccgcagtggcggaggcgccggccgcccgcgccccgcgacgacggcgaggaggcggcctgggaagaagagtcccctggcctgtcagggggtccgggcggctccggggccggaagcaccgtggccgaggccccgccggggaccctggcgctgctcctggacgaaggcagcaagcagctgccgcaggccatcatcatcggagtgaagaagggcggcacgcgggcgctgctggagttcctgcgcgtgcaccccgacgtgcgcgccgtgggcgccgagccccacttcttcgaccgcagctacgacaagggcctcgcctggtaccgggacctgatgcccagaaccctggacgggcagatcaccatggagaagacgcccagttacttcgtcacgcgggaggcccccgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggatggataaccatataatttaaaaagaaaaaaaaaatcaaaatataatatatttttttaccaatcggtagagaagagacagtttaatatttgtgctgaaaatatgtttcagtatttttttcaatgaatgttaagagattgttctcactcccgccccatcttaatgtataaccaacaccaaacacgtggatcaacagaaaaggaaaatttcactcgtctaaacactttcaattttcagtttttattttatgttctatatacccagtcataaagtataagcatcagttgtcattaaaagttttcagaaaatcttgaggttaaacatctctctctctttttttaaaatacaaggccctgataaaattgatatctatccttatatttttctccctttttcccgtgccactttttcttaaattatttcccagttagtattatcatatgtttgtacccgtcacagttttcatagtgctttcaaatacacctttttgatcattaaaataaaaaaataaatcttg

SEQ ID NO: 31514 - DNA, 2786 bp, Homo sapiens
cagcggcggcccaggaggcagccggtgagcgcctgcgagcagagtggcgggggccgctgacaggtcccgcgcagcccagcccagcccagccacgcggctcacaggtggggtccaagagcagtttggagcaacccggcgctacggagaggggtggacggctctgcacgggcctcctgtctcccgctcgggcagagggactcggggggacctcgctccttggccgagagaacctgaactcgggcggagagaacgcgcccaggcgggcaaggggaccagagaaagccggggctggaagtcactgtcgctcgccactgtctggagcgcacggagcgcagaggcccggcagccgcgcgtgccctcccggggaccgagccagtgatgcaggatcgctgagcggagatccgcgccgagaagtctctcggggccggggctgagacgcacgccttcgacaccgctgccaagaccccgattccggcgactcttgcggggaaccgaggggccaaggctgccccaagctcaggacttgggcgagtctaagacgatggtttcttaagcacggacccgcgttccccttcccgccccctcgactggaggcagggatcctgcgcggggcccccgggattccgtttccccgcggagccccggccgctgcctcccgggacagttcgcacggccacaggggcgcacggcgatgtggcctccgtccagcgcgctggcccgccggggggatgctctggcacctgtcggggtccaggcctagcatggccggcgcgttgcccgacgtcgcctccggctaggatggcccctccgggcccggccagtgccctctccacctcggccgagccgctgtcccgcagcatcttccggaagttcttgctgatgctctgctccctgctcacgtccctttacgtcttctactgcctggccgagcgctgccagaccctgtccggccccgtcgtggggctgtccggcggcggcgaggaggcgggggcccctggtggcggcgtcctggccggaggcccgagggagctggcggtgtggccggcggcggcacagagaaagcgcctcctgcaactgccgcagtggcggaggcgccggccgcccgcgccccgcgacgacggcgaggaggcggcctgggaagaagagtcccctggcctgtcagggggtccgggcggctccggggccggaagcaccgtggccgaggccccgccggggaccctggcgctgctcctggacgaaggcagcaagcagctgccgcaggccatcatcatcggagtgaagaagggcggcacgcgggcgctgctggagttcctgcgcgtgcaccccgacgtgcgcgccgtgggcgccgagccccacttcttcgaccgcagctacgacaagggcctcgcctggtaccgggacctgatgcccagaaccctggacgggcagatcaccatggagaagacgcccagttacttcgtcacgcgggaggcccccgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggatggataaccatataatttaaaaagaaaaaaaaaatcaaaatataatatatttttttaccaatcggtagagaagagacagtttaatatttgtgctgaaaatatgtttcagtatttttttcaatgaatgttaagagattgttctcactcccgccccatcttaatgtataaccaacaccaaacacgtggatcaacagaaaaggaaaatttcactcgtctaaacactttcaattttcagtttttattttatgttctatatacccagtcataaagtataagcatcagttgtcattaaaagttttcagaaaatcttgaggttaaacatctctctctctttttttaaaatacaaggccctgataaaattgatatctatccttatatttttctccctttttcccgtgccactttttcttaaattatttcccagttagtattatcatatgtttgtacccgtcacagttttcatagtgctttcaaatacacctttttgatcattaaaataaaaaaataaatcttgctctgttgtataagatcacaataggtaaatattattatccccattttacagaaaggaaaactgagtctttgggaggtgaaataatgtatctaaaggtcaaatgttggatggaccctggacaaaattccatcttccacttgttccctatttcatgtcactttttccagggagaatggaaaagaagacatctgcacctttagaaatggttaggtagttttcagatgatatgaaaagggaaagagagccccttgttttctaa

SEQ ID NO: 31515 - DNA, 2088 bp, Homo sapiens
cagcggcggcccaggaggcagccggtgagcgcctgcgagcagagtggcgggggccgctgacaggtcccgcgcagcccagcccagcccagccacgcggctcacaggtggggtccaagagcagtttggagcaacccggcgctacggagaggggtggacggctctgcacgggcctcctgtctcccgctcgggcagagggactcggggggacctcgctccttggccgagagaacctgaactcgggcggagagaacgcgcccaggcgggcaaggggaccagagaaagccggggctggaagtcactgtcgctcgccactgtctggagcgcacggagcgcagaggcccggcagccgcgcgtgccctcccggggaccgagccagtgatgcaggatcgctgagcggagatccgcgccgagaagtctctcggggccggggctgagacgcacgccttcgacaccgctgccaagaccccgattccggcgactcttgcggggaaccgaggggccaaggctgccccaagctcaggacttgggcgagtctaagacgatggtttcttaagcacggacccgcgttccccttcccgccccctcgactggaggcagggatcctgcgcggggcccccgggattccgtttccccgcggagccccggccgctgcctcccgggacagttcgcacggccacaggggcgcacggcgatgtggcctccgtccagcgcgctggcccgccggggggatgctctggcacctgtcggggtccaggcctagcatggccggcgcgttgcccgacgtcgcctccggctaggatggcccctccgggcccggccagtgccctctccacctcggccgagccgctgtcccgcagcatcttccggaagttcttgctgatgctctgctccctgctcacgtccctttacgtcttctactgcctggccgagcgctgccagaccctgtccggccccgtcgtggggctgtccggcggcggcgaggaggcgggggcccctggtggcggcgtcctggccggaggcccgagggagctggcggtgtggccggcggcggcacagagaaagcgcctcctgcaactgccgcagtggcggaggcgccggccgcccgcgccccgcgacgacggcgaggaggcggcctgggaagaagagtcccctggcctgtcagggggtccgggcggctccggggccggaagcaccgtggccgaggccccgccggggaccctggcgctgctcctggacgaaggcagcaagcagctgccgcaggccatcatcatcggagtgaagaagggcggcacgcgggcgctgctggagttcctgcgcgtgcaccccgacgtgcgcgccgtgggcgccgagccccacttcttcgaccgcagctacgacaagggcctcgcctggtaccgggacctgatgcccagaaccctggacgggcagatcaccatggagaagacgcccagttacttcgtcacgcgggaggcccccgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggattgagcagacccgggctatgtaccttacccacgtggcttatctattgacagagattatatgtatgtaaaatgtaaa

SEQ ID NO: 31516 - DNA, 1820 bp, Homo sapiens
cagcggcggcccaggaggcagccggtgagcgcctgcgagcagagtggcgggggccgctgacaggtcccgcgcagcccagcccagcccagccacgcggctcacaggtggggtccaagagcagtttggagcaacccggcgctacggagaggggtggacggctctgcacgggcctcctgtctcccgctcgggcagagggactcggggggacctcgctccttggccgagagaacctgaactcgggcggagagaacgcgcccaggcgggcaaggggaccagagaaagccggggctggaagtcactgtcgctcgccactgtctggagcgcacggagcgcagaggcccggcagccgcgcgtgccctcccggggaccgagccagtgatgcaggatcgctgagcggagatccgcgccgagaagtctctcggggccggggctgagacgcacgccttcgacaccgctgccaagaccccgattccggcgactcttgcggggaaccgaggggccaaggctgccccaagctcaggacttgggcgagtctaagacgatggtttcttaagcacggacccgcgttccccttcccgccccctcgactggaggcagggatcctgcgcggggcccccgggattccgtttccccgcggagccccggccgctgcctcccgggacagttcgcacggccacaggggcgcacggcgatgtggcctccgtccagcgcgctggcccgccggggggatgctctggcacctgtcggggtccaggcctagcatggccggcgcgttgcccgacgtcgcctccggctaggatggcccctccgggcccggccagtgccctctccacctcggccgagccgctgtcccgcagcatcttccggaagttcttgctgatgctctgctccctgctcacgtccctttacgtcttctactgcctggccgagcgctgccagaccctgtccggccccgtcgtggggctgtccggcggcggcgaggaggcgggggcccctggtggcggcgtcctggccggaggcccgagggagctggcggtgtggccggcggcggcacagagaaagcgcctcctgcaactgccgcagtggcggaggcgccggccgcccgcgccccgcgacgacggcgaggaggcggcctgggaagaagagtcccctggcctgtcagggggtccgggcggctccggggccggaagcaccgtggccgaggccccgccggggaccctggcgctgctcctggacgaaggcagcaagcagctgccgcaggccatcatcatcggagtgaagaagggcggcacgcgggcgctgctggagttcctgcgcgtgcaccccgacgtgcgcgccgtgggcgccgagccccacttcttcgaccgcagctacgacaagggcctcgcctggtaccgggacctgatgcccagaaccctggacgggcagatcaccatggagaagacgcccagttacttcgtcacgcgggaggcccccgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctggcctgaacccacacttcctggactctctctcctaatcatcggctccgatccta

SEQ ID NO: 31517 - DNA, 449 bp, Homo sapiens
tgcctttttgcgtttctcagggacctgatgcccagaaccctggacgggcagatcaccatggagaagacgcccagttacttcgtcacgcgggaggcccccgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctactt

SEQ ID NO: 31518 - DNA, 432 bp, Homo sapiens
atatttgtgctgaaaatatgtttcagtatttttttcaatgaatgttaagagattgttctcactcccgccccatcttaatgtataaccaacaccaaacacgtggatcaacagaaaaggaaaatttcactcgtctaaacactttcaattttcagtttttattttatgttctatatacccagtcataaagtataagcatcagttgtcattaaaagttttcagaaaatcttgaggttaaacatctctctctctttttttaaaatacaaggccctgataaaattgatatctatccttatatttttctccctttttcccgtgccactttttcttaaattatttcccagttagtattatcatatgtttgtacccgtcacagttttcatagtgctttcaaatacacctttttgatcattaaaataaaaaaataaatcttg

SEQ ID NO: 31519 - DNA, 4087 bp, Homo sapiens
  misc_feature (1846)..(1846): n is a, c, g, or t
  misc_feature (2882)..(2882): n is a, c, g, or t
gactcttgaggatccccctgcatccggggagagaaagaggtagactagttttgtgtttgtggctattttaatagagtagcacaagtaatcaaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatgtgatatccctatatcattaaagtaaagcctaagcacattctgtggcttttgtgtctactctgttgttgctgagcttatgaactattagaaataactccctcttgcattttcacacatggggaatgtgatgttctcttgggtattatgctaatcatattttggcaggtttctctggagcagatgcagaaatgatcataccactttccagggtgtattattttagctcctttgacttgggccctaagtctgttttacctgatgttcctgaaagatgttcctgatgtccttcactgttctttcatgctggatgttcttgcctatgctgcctcctcagctatcaccctctcttcccctttttaatgtagaactcattcttaatgatttgtcaaaggcaccctatttcactgaaatgccttctatattccctaccctccaagtggattgtagaccttctaaggtcttttgacatctgcatatctctagcacagcacttaccacggtgattatttatctgttcatctttccaagtagacactctcattttaactccctaccctagtcgccagcatccccagcatagtgcctgtcataaaatggtgccacaatgaaaatttgaaaaatgaatgaacgtgataaacatagatgagaatcctatattctacaattttttaaatgtactgaaattattctttttgaatcctcctatttatttctgtgacttctttggtgacaaagttagaaaaaagtggaggtcagtagggagatatgaagggacgcaagtggaagcagtgagcctgggcgggtgatggagtgggagatacgtggcacaggggtcagtgagttaatctgggctcattcagagaatggaaggtgtgtgccaagaaaactggttggatagggataggtcagggattccctcttgcattctcacacttgggggcatgtgtcattttcttttcttttcttttttttttttttttttttgagacggagcatcgctctttctcccaggctggagtgcaatggtgctatctcggctcactgcaacctccacctcccgggttcaagctattctcatgtctcagccttccaagtagctgggactacaggtgcctgccaccatgctcagctaatttttgtatttttagtaaagatggggtttcaccatgttggtcaggttggcctcgaactcctgatctcaggtgatccacctgcctcggcttctcaaagtgctgggattccaggcatgagccaccatgcctggccgcatgtgtcattttcttgggtgttatactgatcgtatatttgcaggtttgcttttgtgacagacttcttctgggggaaaaaaagtatccttctatctttttacttttgtccagttccaggtatccctgtttttttcttcactcttccttccttgttcatgggagtttttcttgaggacttcaagcccagcttcggagaatcctggttgtgtcatctcatctcctttctgctctcttctctacctagcctttccaccctcacacctccnggggtctgaaaatggaaagataagggtgtttccctgaaagttgctcttctgtgtggggatgacaggttctaaagactcttttctggtccctgccctcattgccatgattaatcagttaagtggcccgaggttttataacagcacagtcttaaaatgcttctcccaagtttaatttctctccatttgaccttttaaggatgtgaattggctttaagcagtagactccctttagtacggcgctgtgagcctctcagtgaatctgctacatccattccacccacgggtctggaaacttgtctgtttacctttccctaaaaacctaagatatatttttaagaagtgccttgtaacttttcatatagcctttcccctactttgggtagactgtttcttacaggaatttggtagatctttccaaagagaattctgtatctctatttttaaagcataaatcctgtcaactttggaggagaactgatttggcttgagttttctcagacatgggaacttttgacctaagtttgtattttacattgttgaaagggaactccgggatcccagaaaacatatggactgcaattgggtaaagtttctgtttcagtaatgcctcttctggacatttcatacaaatggaaacatgcagcatgtagtaatttatgacagcttctttcacttagcatgaggttttcaaagttcattgatgtggtagcatttgtcagtactctgtgcctttttatggctgaataatattttatcatatggatttaccacattttatcattttatttatccatcatcagttgattgacatttgagttgcttctactttttgagtattatcaataattctgttatgaacattcttgtataattttttggtagacatttatcttcatatttcttggatatatacctaggagcagaattgctgcgtcagatggtaatgctgtttaaccttttcaggaactgtcagactgttctgaagtgggtacattattttacattccaaccagcagtgtatgagaattccagtttntccacatcctcatcaacagttgttattgtctgtcttttttattatattcatctgtaatgtgaagtgtttatctcattgtggttttgatttacatttccctgatggttgatgattttcaacatcttttcatatacttattagtcattatgtatcttctttggagaatgtctgttcagatcctttacctactttataattggtttatctttttaatattgaactgtaatagttttaaaaaaatatatcctaaatacaagtctcttatcagataatatgacttgcagatattttctgtcattctatgtactgtcttttcacattcttgatgatatacttttcagcccaaatgtttttaacttgatggaatacaatttattttttcttttgttgcttgtgctttcagtcatatttgtgaaaactttgcttatcccacattacaaagatttactacttctaagtgatttataattttaccacctacctttaggtctctgatccattttgagttaatttttatgtgcaaggagggagtctaacttgattcttttacatgtggatatttagttgtcccaggaccatttgttgaattaagtgcccagaacaagtacatctatatatagagaaagtagattagtggttgtcagagactgcaagaagtggggaattggagagtgactgcccataggtacaggcatgctttttggcattatgaaaatattctggaattaggtagtggtgatggttgcagaacttttggaatatggtaaaagacactgaaatatatgcttaaaaatggtgatttttgtgatatatgaattatactatggaactaataataacagtaataaagcaaggtgtctttccacatctccatgccttgtattttcattaaaaaaaaaaaaaaaaaaaaaaaagcatttcagggccaggctcagtggtttactcctgtaatcccagcacttttggaggcctaggtgggaggatcgcttgaggccagaagttcaaaaccagcctgagcaacatagcaagaccttgtctccatgaaaaataaaaaattagccagaaatggtgatgtgtgcctagagttccaactacttggaaagctgaggcaagaggatcacttgagcctaggagttcaaggttgcagtgatctataatcaccactgcactccagcctgggtgacagaacaagaccctgtctcaaa

SEQ ID NO: 31520 - DNA, 4485 bp, Homo sapiens
  misc_feature (1846)..(1846): n is a, c, g, or t
  misc_feature (3280)..(3280): n is a, c, g, or t
gactcttgaggatccccctgcatccggggagagaaagaggtagactagttttgtgtttgtggctattttaatagagtagcacaagtaatcaaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatgtgatatccctatatcattaaagtaaagcctaagcacattctgtggcttttgtgtctactctgttgttgctgagcttatgaactattagaaataactccctcttgcattttcacacatggggaatgtgatgttctcttgggtattatgctaatcatattttggcaggtttctctggagcagatgcagaaatgatcataccactttccagggtgtattattttagctcctttgacttgggccctaagtctgttttacctgatgttcctgaaagatgttcctgatgtccttcactgttctttcatgctggatgttcttgcctatgctgcctcctcagctatcaccctctcttcccctttttaatgtagaactcattcttaatgatttgtcaaaggcaccctatttcactgaaatgccttctatattccctaccctccaagtggattgtagaccttctaaggtcttttgacatctgcatatctctagcacagcacttaccacggtgattatttatctgttcatctttccaagtagacactctcattttaactccctaccctagtcgccagcatccccagcatagtgcctgtcataaaatggtgccacaatgaaaatttgaaaaatgaatgaacgtgataaacatagatgagaatcctatattctacaattttttaaatgtactgaaattattctttttgaatcctcctatttatttctgtgacttctttggtgacaaagttagaaaaaagtggaggtcagtagggagatatgaagggacgcaagtggaagcagtgagcctgggcgggtgatggagtgggagatacgtggcacaggggtcagtgagttaatctgggctcattcagagaatggaaggtgtgtgccaagaaaactggttggatagggataggtcagggattccctcttgcattctcacacttgggggcatgtgtcattttcttttcttttcttttttttttttttttttttgagacggagcatcgctctttctcccaggctggagtgcaatggtgctatctcggctcactgcaacctccacctcccgggttcaagctattctcatgtctcagccttccaagtagctgggactacaggtgcctgccaccatgctcagctaatttttgtatttttagtaaagatggggtttcaccatgttggtcaggttggcctcgaactcctgatctcaggtgatccacctgcctcggcttctcaaagtgctgggattccaggcatgagccaccatgcctggccgcatgtgtcattttcttgggtgttatactgatcgtatatttgcaggtttgcttttgtgacagacttcttctgggggaaaaaaagtatccttctatctttttacttttgtccagttccaggtatccctgtttttttcttcactcttccttccttgttcatgggagtttttcttgaggacttcaagcccagcttcggagaatcctggttgtgtcatctcatctcctttctgctctcttctctacctagcctttccaccctcacacctccnggggtctgaaaatggaaagataagggtgtttccctgaaagttgctcttctgtgtggggatgacaggttctaaagactcttttctggtccctgccctcattgccatgattaatcagttaagtggcccgaggttttataacagcacagtcttaaaatgcttctcccaagtttaatttctctccatttgaccttttaaggatgtgaattggctttaagcagtagactccctttagtacggcgctgtgagcctctcagtgaatctgctacatccattccacccacgggtctggaaacttgtctgtttacctttccctaaaaacctaagatatatttttaagaagtgccttgtaacttttcatatagcctttcccctactttgggtagactgtttcttacaggaatttggtagatctttccaaagagaattctgtatctctatttttaaagcataaatcctgtcaactttggaggagaactgatttggcttgagttttctcagacatgggaacttttgacctaagtttgtattttacattgttgaaagggaactccgggatcccagaaaacatatggactgcaattgggtaaagtttctgtttcagtacttattcctacttactagccgtttaatcttggtcaagtcagccatgtggctctcaacttcctcatctgtaacataaaaggattagagcagacaatctctaacaaatgctataataccactgacaaataataatattagctaatatgtgtaaggcactgtgtttagtgctttttcccttaatacaatagctttgagatataatttatataccatacaatttacttcttaaaaaagtacacaattcagtaattttaatagataggagtaaccatcaccacagtcaattctagaatatttttatacatcagaagaaaccctttacccattatcaattactctccattcctcctaactccctcccagccctaggcaactactagtctactttctgtctttatatgcctcttctggacatttcatacaaatggaaacatgcagcatgtagtaatttatgacagcttctttcacttagcatgaggttttcaaagttcattgatgtggtagcatttgtcagtactctgtgcctttttatggctgaataatattttatcatatggatttaccacattttatcattttatttatccatcatcagttgattgacatttgagttgcttctactttttgagtattatcaataattctgttatgaacattcttgtataattttttggtagacatttatcttcatatttcttggatatatacctaggagcagaattgctgcgtcagatggtaatgctgtttaaccttttcaggaactgtcagactgttctgaagtgggtacattattttacattccaaccagcagtgtatgagaattccagtttntccacatcctcatcaacagttgttattgtctgtcttttttattatattcatctgtaatgtgaagtgtttatctcattgtggttttgatttacatttccctgatggttgatgattttcaacatcttttcatatacttattagtcattatgtatcttctttggagaatgtctgttcagatcctttacctactttataattggtttatctttttaatattgaactgtaatagttttaaaaaaatatatcctaaatacaagtctcttatcagataatatgacttgcagatattttctgtcattctatgtactgtcttttcacattcttgatgatatacttttcagcccaaatgtttttaacttgatggaatacaatttattttttcttttgttgcttgtgctttcagtcatatttgtgaaaactttgcttatcccacattacaaagatttactacttctaagtgatttataattttaccacctacctttaggtctctgatccattttgagttaatttttatgtgcaaggagggagtctaacttgattcttttacatgtggatatttagttgtcccaggaccatttgttgaattaagtgcccagaacaagtacatctatatatagagaaagtagattagtggttgtcagagactgcaagaagtggggaattggagagtgactgcccataggtacaggcatgctttttggcattatgaaaatattctggaattaggtagtggtgatggttgcagaacttttggaatatggtaaaagacactgaaatatatgcttaaaaatggtgatttttgtgatatatgaattatactatggaactaataataacagtaataaagcaaggtgtctttccacatctccatgccttgtattttcattaaaaaaaaaaaaaaaaaaaaaaaagcatttcagggccaggctcagtggtttactcctgtaatcccagcacttttggaggcctaggtgggaggatcgcttgaggccagaagttcaaaaccagcctgagcaacatagcaagaccttgtctccatgaaaaataaaaaattagccagaaatggtgatgtgtgcctagagttccaactacttggaaagctgaggcaagaggatcacttgagcctaggagttcaaggttgcagtgatctataatcaccactgcactccagcctgggtgacagaacaagaccctgtctcaaa

SEQ ID NO: 31521 - DNA, 1041 bp, Homo sapiens
atggatacaggccccgaccagtcctacttctccggcaatcactggttcgtcttctcggtgtaccttctcactttcctggtggggctccccctcaacctgctggccctggtggtcttcgtgggcaagctgcagcgccgcccggtggccgtggacgtgctcctgctcaacctgaccgcctcggacctgctcctgctgctgttcctgcctttccgcatggtggaggcagccaatggcatgcactggcccctgcccttcatcctctgcccactctctggattcatcttcttcaccaccatctatctcaccgccctcttcctggcagctgtgagcattgaacgcttcctgagtgtggcccacccactgtggtacaagacccggccgaggctggggcaggcaggtctggtgagtgtggcctgctggctgttggcctctgctcactgcagcgtggtctacgtcatagaattctcaggggacatctcccacagccagggcaccaatgggacctgctacctggagttccggaaggaccagctagccatcctcctgcccgtgcggctggagatggctgtggtcctctttgtggtcccgctgatcatcaccagctactgctacagccgcctggtgtggatcctcggcagagggggcagccaccgccggcagaggagggtggcggggctgttggcggccacgctgctcaacttccttgtctgctttgggccctacaacgtgtcccatgtcgtgggctatatctgcggtgaaagcccggcatggaggatctacgtgacgcttctcagcaccctgaactcctgtgtcgacccctttgtctactacttctcctcctccgggttccaagccgactttcatgagctgctgaggaggttgtgtgggctctggggccagtggcagcaggagagcagcatggagctgaaggagcagaagggaggggaggagcagagagcggaccgaccagctgaaagaaagaccagtgaacactcacagggctgtggaactggtggccaggtggcctgtgctgaaagctag

SEQ ID NO: 31522 - DNA, 392 bp, Homo sapiens
  misc_feature (45)..(45): n is a, c, g, or t
  misc_feature (143)..(143): n is a, c, g, or t
  misc_feature (191)..(191): n is a, c, g, or t
  misc_feature (290)..(290): n is a, c, g, or t
atgtctggtcgcggcaaacaaggcggtaaagctcgcgccaaggcnaagactcggtcttctcgtgcaggtttgcagtttcctgtgggccgagtgcaccgcctgctccgcaaggcaactactccgagcgcgtcggggctggcgcnccggtgtatctcgcggcggtgcttgagtacctgaccgccgagatcctngagctggcgggcaatgcggcccgcgacaacaagaagacccgcatcatcccgcgccacctgcaattggccatccgcaatgacgaggagcttaataaactnttggggcgtgtgaccatcgcgcagggtggcgttttgcctaatattcaggcggtgctgctgcctaagaaaactgagagccatcataaggccaagggaaagtga

SEQ ID NO: 31523 - DNA, 424 bp, Homo sapiens
aatggattaataaatattttaaaatatctgttttaattcataatatggtgactattgatagataaacctacataaacaaaatattgatagatatacctacatacacaaaagctatttgggattctttctaaaagtgtaaaaagggccgggcgtggtggctcacgcctataatcccaggactttgggaggccaaggcaggtggatcatgaggtcaggagatcgagaccatcctggctaacatggtgaaaccccatctctactaataatacaaaaaattagccaagcgtggtggcgggcacctgtagtcccagctacttgggaggctaaggcaggagaatggcgtgaacccaggagtcggagcttgcagtgagccgagatcgcaccactgcactccagcctgggcaacagagcgagactccatctc

SEQ ID NO: 31524 - DNA, 1540 bp, Homo sapiens
catagagttgggagtttctcctggattgcaccatgctgtattgggaggaggtcaggctgcgctgggcatatctaataagctttttcttctcttctacatgtttttggcattgtgctcaactgaagtagtacaaattcttaactatgttcaggaattctcacaaaggcaatgtgatcagcgtggtgttaagttcatatatctatgaagaaacgaggaccagtggtgtttgtttttacgcttttcattttaaatttatattttatttattattttaatttttgtgagtacgtagtacatatatgtatctatggattatatcactgattttgatgaaggcatgaaatgcacaaaaataacatcagataaatggttattcattgcctcaactatttgttctttattttacgaacaatctaataacattcttttagttacttaaaaatgtacaattaaattgctttgactatagtcactcccgaccagagaaaaaccctgtagacattagtcactcctcattctgtctcaaaccctctccctgaccctcagccctaggtagcaactacctagtgcgatcaatcccatatgcatagattaccatattgtggacatttcctataagcggaattgcacaataggggagctgttatgactgacataacacgtagcacaatattttcaagattcgtccacattgtaggcttacccacagggggaaaccatttttttgggggcttttagtaacaccggtgttttctccttccttacgtccttcttccttccttccttccttccttccttccttccttccttcctgacttccttctttccttccctccttcctcctatttctctcttactccttctgccctctctctttcctatgccttaggtgcatcccacattctgcgtttttttggggaaatcctcgacaggtgcaggaaaattgtgttattgtaactatttaccgttatctctctttcacggctctccatcagttgtgaacatctattggtttatcccaagtcactaagcatattttcattaggtaaacctgtttttccttatacagctgtttctggagtatagggtcgcatactcataaacccagtgtaactcagaaacgcatctaatattccagtaaacccatcataacgttgaaaaatcgtaaatcaaaccatcataagtcacggtttgtccgtggatatgggcgtcatcaattccattgtattcagtaatgctgtacaccattaacaatggcagactgattgggagtggatattgatagcattataaaagtcagttattagagggatacttctttaacctgactgaagaactgatctaatggctttagtacagtgcatgattatgtgcgatgttttgagacagagtagtacatttgtgaatgaaattttatggcttttttttcacttagtaggaaccattgtgtgtggaaaagtgagaaaatggctttctgctgtagggtctggcattcattgtagatgtaagcttatttttctgtgagcaaatcttattcaat

SEQ ID NO: 31525 - DNA, 1517 bp, Homo sapiens
catagagttgggagtttctcctggattgcaccatgctgtattgggaggaggtcaggctgcgctgggcatatctaataagctttttcttctcttctacatgtttttggcattgtgctcaactgaagtagtacaaattcttaactatgttcaggaattctcacaaaggcaatgtgatcagcgtggtgttaagttcatatatctatgaagaaacgaggaccagtggtgtttgtttttacgcttttcattttaaatttatattttatttattattttaatttttgtgagtacgtagtacatatatgtatctatggattatatcactgattttgatgaaggcatgaaatgcacaaaaataacatcagataaatggttattcattgcctcaactatttgttctttattttacgaacaatctaataacattcttttagttacttaaaaatgtacaattaaattgctttgactatagtcactcccgaccagagaaaaaccctgtagacattagtcactcctcattctgtctcaaaccctctccctgaccctcagccctaggtagcaactacctagtgcgatcaatcccatatgcatagattaccatattgtggacatttcctataagcggaattgcacaataggggagctgttatgactgacataacacgtagcacaatattttcaagattcgtccacattgtaggcttacccacagggggaaaccatttttttgggggcttttagtaacaccggtgttttctccttccttacgtccttccttccttccttccttcctgacttccttctttccttccctccttcctcctatttctctcttactccttctgccctctctctttcctatgccttaggtgcatcccacattctgcgtttttttggggaaatcctcgacaggtgcaggaaaattgtgttattgtaactatttaccgttatctctctttcacggctctccatcagttgtgaacatctattggtttatcccaagtcactaagcatattttcattaggtaaacctgtttttccttatacagctgtttctggagtatagggtcgcatactcataaacccagtgtaactcagaaacgcatctaatattccagtaaacccatcataacgttgaaaaatcgtaaatcaaaccatcataagtcacggtttgtccgtggatatgggcgtcatcaattccattgtattcagtaatgctgtacaccattaacaatggcagactgattgggagtggatattgatagcattataaaagtcagttattagagggatacttctttaacctgactgaagaactgatctaatggctttagtacagtgcatgattatgtgcgatgttttgagacagagtagtacatttgtgaatgaaattttatggcttttttttcacttagtaggaaccattgtgtgtggaaaagtgagaaaatggctttctgctgtagggtctggcattcattgtagatgtaagcttatttttctgtgagcaaatcttattcaat

SEQ ID NO: 31526 - DNA, 1057 bp, Homo sapiens
gcatcttttgtactatttataattaaccagtaagttattttccctgagttttatgtgccattctatcaaattagtcaaatccagttgtggggtccacgggatttgtggtttatagctcatcagtcaaaagcagaggctctggggctttgattgtcatcagaaatgggagcctcagtcttggtgactgagtcctcaaactgggggatgtgatgctatctgcaggtagataatgactgagttgaactggaggacccccagcttgtgtccacgggaggattgcttggtgtgtgtggaaaacaccctgcacatctggtcacagaattattccatattgattgttgttgtgttgtgtgacagacaatagaggaaaagtttatttttttctacacatacgctatggcttcccttctattattccatatctttcaactcctgccatactatttctttctctccaagtttttgttcttcctcagagttcccataaatggaaaggatacgcacttcattgaaataagaatttcatgttagccaagttttcaggatagccatgagtttcacttaattatctgagaacttagagcttactgtcctctacttactatccactgagacttaatgtgttcttggccatcacagaaactttactagctacttatgccattgtcaatggataactctctgaatccacattaataactttgtaattagcttagtcctcagctgtttttcagagataatccccagtcttcatgcagacactatcactgcacctacaggtgaaatgataatcacttcctagcaaggaggttggatcatggaatacaagataatttctcaggaatcagatggtcttattccacacctgcaggaatgtcagcattgcaaccaccatggcaaatattgatttaataaacaattactattcccagataagtgtcaaaatcttagaagaaattgtcatatcttagacaatttagaagtgatggagggtggatgatgagaaattatcgcaccactgcactccagcctgggcgacagagcaagactctgtctc

SEQ ID NO: 31527 - DNA, 282 bp, Homo sapiens
tttgcatagaggaagaaaatatcgtaggaaatagaaacttcaagaagaaagttgacagtaaaggtgaaataatgtttaatcatgtgatttatggaatatgagttagatttttataaattgaaatagttttggccaatatatgggtcaagaatagatttatatgacaggtgatattttacatttataggaagtactttgattacattttctcttttgaaagtatgactcatatctgaactacaaagtcagcctaattaaatgatatttggcttgatttttgtt

SEQ ID NO: 31528 - DNA, 449 bp, Homo sapiens
cccacctgcccagctcatggctggcaacattggcatctgagtaagccaccaacacgcccaagatctggcctgcgtagacccactaacacccatgccagcatatgtcaccctgggaccaaaggataggcatgctaagcccaccactacacctactgaggcccaaagactggcctacttggaatccagtctccagcagaacatcaccacagcctcaactaacaaccacaccctaagccacaaaggaaatcatagataccactgatgctcttcacagacaaaaaaaaaagtcagagactacactactgcacgcaccaagaatcaaagccaaagtgctctacccagccaacaccctggattcatcttcaggaaaaagtaatcacctatgaaagcaaattcaaaaaaggagaagacatggtggatacactagatgcacagatatcaacataaga

SEQ ID NO: 31529 - DNA, 443 bp, Homo sapiens
tagatattgtgttatttaaatgacaccttaattaaggtgtttaaaagaaaaattcccctgagtttctcctgcttgcatttgaagtgaaaacccagctcctcatggggtggccacctccccccggcagctctttctgtctctgcttcatccatggggctttctccagtttctcaccccaccctccttcccatgagtgctccagcaggtgctgttccctctgcctggcacgctttcttgcttctccacttccttggagtaactcagagtcttcttcaactctctacctcaagtcacgtctcgcaggaagcctctctggctctgcccactgcagtcctacctccctgcccttctccttggggacactcatcactcctgaaactgttgactcttctcctaagtacagcttctggctcatagtgggtgctcaataaatatttcataaa

SEQ ID NO: 31530 - DNA, 573 bp, Homo sapiens
cttgtgaggattgtgtggattttcatctcatctcaaggtgtcatctcttccagagacctgtcttccctaaccagtaccctgcacctcattcccatcaaagctggaggagagtctctcctctgtgctcccgagcccctgtacatccccagtcacatctccactcatcctggttttcccatttccgtggctgtctccttggcctgactgtgtacctggtgacagcaggggctgtgttggaaccagctcagtgtctcacagtatgcagaccaaataccccatggaatggcttctggatagtctggtgaaggcctggcatccactcccccttcctaacaacatcctgagttccttttaacagcttttcttcctcatctggtggagcattgctgcatgctcattcccagattttaaatctgaagtacagcaacagactgaaaaagactggagtttgttctagtggctgtgttctaaccagaacccagtatgaggtcacacttgtttttcttatttccctcccaaaaatgttgtttactgcttgataatccatctaataaattttcttatttcttaagt

SEQ ID NO: 31531 - DNA, 1167 bp, Homo sapiens
  misc_feature (286)..(286): n is a, c, g, or t
  misc_feature (450)..(450): n is a, c, g, or t
  misc_feature (651)..(651): n is a, c, g, or t
  misc_feature (754)..(754): n is a, c, g, or t
  misc_feature (926)..(926): n is a, c, g, or t
  misc_feature (964)..(964): n is a, c, g, or t
  misc_feature (1091)..(1091): n is a, c, g, or t
cctcggaccccattctctcttcttttctcctttggggctggggcaactcccaggcgggggcgcctgcagctcagctgaacttggcgaccagaagcccgctgagctccccacggccctcgctgctcatcgctctctattcttttgcgccggtagaaaggatgacgcctcaaccctcgggtgcgcccactgtccaagtgacccgtgagacggagcggtccttccccagagcctcggaagacgaagtgacctgccccacgtccgccccgcccagccccactcgcacacnggggaactgcgcagaggcggaagagggaggctgccgaggggccccgaggaagctccgggcacggcgcgggggacgcagccggcctaagagcgagttggcactgagcaagcagcgacggagtcggcgaaagaaggccaacgaccgcgagcgcaatcgaatgcacnacctcaactcggcactggacgccctgcgcggtgtcctgcccaccttcccagacgacgcgaagctcaccaagatcgagacgctgcgcttcgcccacaactacatctgggcgctgactcaaacgctgcgcatagcggaccacagcttgtacgcgctggagccgccggcgccgcactgcggggagctgggcagcccaggcggtncccccggggactgggggtccctctactccccagtctcccaggctggcagcctgagtcccgccgcgtcgctggaggagcgacccgggctgctgggggccacctnttccgcctgcttgagcccaggcagtctggctttctcagattttctgtgaaaggacctgtctgtcgctgggctgtgggtgctaagggtaagggagagggagggagccgggagccgtagagggtggccgacggcggcggccctcaaaagcacttgttccttctgcttctccctngctgacccctggccggcccaggcctccacgggggcggnaggctgggttcattccccggccctccgagccgcgccaacgcacgcaacccttgctgctgcccgcgcgaagtgggcattgcaaagtgcgctcattttaggcctcctctctgccaccaccccataatcncattcaaagaatactagaatggtagcactacccggccggagccgcccaccgtcttgggtcgccctaccctcactca

SEQ ID NO: 31532 - DNA, 379 bp, Homo sapiens
atggggcacagccaggccatcaccccggggccaccgtcgcaggcaggtggaggctggcagcccagaggcagacaggggcttggaggcagggtggggagcaaggccaaggccgctctctggcccccagtgtcacaggatgacctcagccctggcctggccccagagcaggttggttcactgctgggccctgtggacttgttctcatgctttgtcagtgtcgatgtcgaaagcccaaagtgtttcccaagtcctgctaccttggtaagactcaaccctcaatctcagtctcccctgcagatctctgtggggcttggtctgaactttcgttaggtgagtgtggagtaggcattattgtacattgtagtcctttctcctcaaa

SEQ ID NO: 31533 - DNA, 573 bp, Homo sapiens
tgcttcacttcaggcaccagcttaacaaatttcatgcgtagacctaactttaaaacttttcagccaaagtcttgcatagcactattcctgaaatcagaaaggatctcctgttagacataacaggaataatacagggacttctcatatcactcagccactccaaagcttttgtgaaattatactttacataaattcagaataatccccctctaccgaatgcctcagccagttaacttctctgtactccaaatgttttgtctctcatcttaatgcatgctatatgtgtgtgacagtattaataaagcaaaaaggctggatgcagtgactcacgcttgtaatcccagcactttgggagcccaaggcgggcagatcacctgaggtcgagagtttgacaccagcctgaccaccttggagaaaccctgtctctactaaaaacacaaaaaattagctgccgtggtggcgcatgcctgtgatcccagctacttgggaggctgaggtaggagaatcgcttgaacccaggaggtgtaggttgcggttagccgagatggcgccattgtactccagcctgggcaa

SEQ ID NO: 31534 - DNA, 1808 bp, Homo sapiens
gtagacttgtgtcaccatcaccacaaagggtacagaacaattccactgcaccaacaaattccacctgtgctgcttttttttaagagtggctccccaccccgcattgagtataaaggctttgattttcatcagtgttgtgtcatttattcatttttattgctgagtagttttccatgttaggtaccacaatattcttagccattaacccactgaagcacatttaggttgtttataatttttagtgattatgaataaaactattagaaacattaggtttttgtatgaacataaatattcatctctgtagggtaaatattggagtgaaatggttaggtcatatggtgagtgtatgtttacctttgtaacacagggccaaccttttccagaatgattaattttgttttcccaccagcaacgtatgaagatgtggttgctccataatttgccaacaccaggtattctcattgtttttattttatccattctagtagatgtgtagtggtatctcaatgtggcttcaatttgcatttccttagtgactaatgatgttgagcatcttttcgtgtgcttattgtccatctgtgtatctttgatgaagtgttcaaatcttttgccattttaaaagaattctattgtttgttttcctagtttagttttgtagtttgtggcttgtctttttattctcttttattcaatttttatttcagtgtcttttataaagcaaaggttttaaatgttaatgaagtccagtttttccctctatggaccatactttggtgtcatatttaagaaccccatccctaactaatgtttaggaaatttttcttctagtagcttaatgataatgtttttcacttacatccattttaggtaatttttatataaggtgttaaataaaggcccagctcattgtttttacatgtggttatccagatgtttcagcatcatttgtggaaaacatagtgtttctccattgaattgcctttgcccttttgtcaacaattgattgatcatagttaagcgggtctgtttctcagttttctgttctattccattgatctatgtgtccatccctttgccaaagccacacattgtcttgattactgtagctttgtagtaaatctcaaaatcaggtaatgtaagcccttcaaatttattctttttctaatttatatgtttccactgtcatatatttgtctatatattatgtcaagttttactttatatattttgacactcagttgttatccaaatacaggctaagaattgtcaaatctctggtgatttgaatgttttcccattatgtagcaactttctttaaacataagaatactttataacagataatattggggtttttttgggggggaggaggtttgaaacaaggtctcactctctcacccaggctggagtacagtggtggtgcgattttggctctttgcaacctcaacctcctgggctcaagcagtccttccacctcagtctctcgagtagctgggattacaggcatgcaccaccacacccagctaaattttttgcatcttttgtagaaatggggtttcaccatgttggccaggctggtcttgaaatcatgagctcaagcaatctgcccaccttggcctcccaaagtgctggaaatacaagcatgagccactctgctccaccacagacttattgagatataatttatataccataaaattcatccatttaaaatgtacaattcagtgcacagagttgtatgaccatcaccacaataaatcttagaacattatcacctctaaaataaaacttttagctataacttc

SEQ ID NO: 31535 - DNA, 829 bp, Homo sapiens
actactactactactaaattcgcggccgcgtcgacagttaagcgggtctgtttctcagttttctgttctattccattgatctatgtgtccatccctttgccaaagccacacattgtcttgattactgtagctttgtagtaaatctcaaaatcaggtaatgtaagcccttcaaatttattctttttctaatttatatgtttccactgtcatatatttgtctatatattatgtcaagttttactttatatattttgacactcagttgttatccaaatacaggctaagaattgtcaaatctctggtgatttgaatgttttcccattatgtagcaactttctttaaacataagaatactttataacagataatattggggtttttttgggggggaggaggtttgaaacaaggtctcactctctcacccaggctggagtacagtggtggtgcgattttggctctttgcaacctcaacctcctgggctcaagcagtccttccacctcagtctctcgagtagctgggattacaggcatgcaccaccacacccagctaaattttttgcatcttttgtagaaatggggtttcaccatgttggccaggctggtcttgaaatcatgagctcaagcaatctgcccaccttggcctcccaaagtgctggaaatacaagcatgagccactctgctccaccacagacttattgagatataatttatataccataaaattcatccatttaaaatgtacaattcagtgcacagagttgtatgaccatcaccacaataaatcttagaacattatcacctctaaaataaaacttttagctataacttc

SEQ ID NO: 31536 - DNA, 396 bp, Homo sapiens
gtgacagtttcacttttattgcccaggctggagtgcaatggcgtgatcctgactcactgcaacctccgcctcctgggttcaagtgattctcctgcctcagcctctcaagtagtctcagtgggattacaggtgcccactgccacgcccagataatttttgtatttttagtacagacagggtttcaccatgttggccaggctgatctcgaactcctggcctcaggcgatctgcccactttggcctcccttccaaagtgctaagattacaggcgtgagccactgagcccagcctgtactcattttttgaatcctgagtgccaagcccagtgctagacacactgtagattctcaataactgttgaacaaaacgaatcttcttcattgtaccccaagtcaa

SEQ ID NO: 31537 - DNA, 216 bp, Homo sapiens
ctctaccttgtcatgtcatggaagaggtacacattcaatggaagaattaggggacagaagtaaagccttgtatatattctgtcccctaattcttccattgaatgtgtacctctaccttgtcatgtcatggaagatacaacatttggaagatctgacaattggaatgactttggaataataaaattgactaattggaaattttgcatattctgaaaa

SEQ ID NO: 31538 - DNA, 3089 bp, Homo sapiens
  misc_feature (3)..(3): n is a, c, g, or t
  misc_feature (7)..(7): n is a, c, g, or t
ggnaganggcggggctcaggtgcctggcagcgcggccggggcccaggaaggggagggggcgaacgctggagcgaggcgggggcgggtgaggagggggtgacgccggacgcgtcgacagcgcgagggttcgcgcgtgagctgcgcgggtcgggcctggtaccgagctttcctgggggctagcaggtcgtggacgccggctcctggaggagagccggtaggagggaggtgaaggtgtccgcggcgtcgtcgacggcggcgccggccatggaggagacgcagccgccgccgcagcctaagctgcccctgtgcgacagcctcatgatctggctgcagacattcaatactgcctcaccttgtcaagatgtcaaacagctgactagtggagttgccatggcacaagttcttcatcaaattgatgcagcttggtttaacgaatcttggttaagccgaattaaagaggatgttggggacaactggagaataaaggccagtaatgtaaagaaggtccttcaaggaattatgagttattatcatgagtttttggggcagcagatttcagaagcacttatccctgatttaaaccaaataaccgaatgttcagatccagtggagcttgggaggttgctccagcttattttaggttgtgcgatcaactgtgaaaagaagcaagaacatattcaaaatataatgacactggaagagtctgttcaacatgtggtcatgactgctattcaagagttgatgagtaaagaaatattgagctctcctccaaatgatgctgttggagaattggagcaacagcttaaaagagccttggaagaacttcaggaagcactagcagaaaaagaagagctgaggcaaagatgtgaagaattggatatgcaggtgactacacttcaagatgaaaagaattcactggtttctgaaaatgagatgatgaatgaaaaacttgaccagttggatggctcttttgatgatccaaacacagtggttgcaaaaaagtattttcatgcacaattacaactagaacaattacaggaagaaaacttcaggcttgaagctgcaaaagatgattaccgtgttcactgtgaagaacttgaaaagcagctaatcgaattccagcataggaatgatgaattgactagtcttgcagaagaaacaagagccctgaaagatgaaatagatgttcttagggctacctctgataaagcaaataaactggagtcaacagttgagatatatcgtcagaagctacaagatctgaatgaccttcgcaagcaggtgaaaactttacaggaaaccaacatgatgtatatgcataatacagtcagcttagaagaagaattaaaaaaagcaaatgcagcacgtacacaattagaaacatacaaaaggcaggttcaagatcttcatgttaaactttcctccgaatccaagagggcagacacactagcgtttgaaatgaagcggcttgaagaaaaacatgaagctttacttaaggaaaaagagagactaattgagcagcgtgatactttgaaagaaacaaatgaagagcttcgatgttcacaagtacaacaggaccacctaaaccaaacagatgcatctgctacaaaaagttatgagaatcttgctgctgagattatgccagtggaatatagggaggtgtttattcgactgcaacatgaaaataagatgcttcgcttacagcaagaaggctctgagaatgaacgtattgaggaacttcaggagcagctagaacagaaacaccgtaaaatgaatgaactggaaactgagcagaggctgagcaaagagcgtattagagaattgcagcagcagattgaggacctccagaaatctttacaggaacaaggttccaagtctgaaggcgaaagttccagcaaattaaagcagaagttggaagctcatatggaaaaactcacagaggtccatgaagaattacagaagaaacaagaactcattgaagatcttcagccagatataaatcaaaatgtacaaaagatcaatgaacttgaagctgctcttcagaagaaagatgaagatatgaaagcaatggaggaaagatataaaatgtacttggagaaagccagaaatgtaataaaaactttggatcccaagttaaatccagcatcagctgaaataatgctactaagaaagcagttggcagagaaagagagaagaattgagattctggagagtgaatgcaaagtagcaaaattccgtgattatgaagaaaaactcattgtttctgcgtggtataataagagtctagcattccagaaactggggatggaatctagacttgtgagcggcggtggtgcctgcagtgacactggtgcgtgcactcctgcgcggtctttcttagcgcagcaacggcacatcaccaacaccagaagaaatctctctgttaaagtccctgctacaacatctgattaaactgcaaaaaaaacaaaacaaaacaaaaaaacccacataaaatagaagtgtccttaaaatattttgtacctttcaactaactaccagattgaaaaagagtttatgatgcgggatatcaggtattttaaaatcaacatgcatcaaattaattttgccagttgactttaaaaacaaattatagaattagccatctctctgagggagcacatttgaataattggagatgcagttatacacacatttcaaacaaacatttgtcttttgagagtattataatttcaaattggccttgtatattttagttaaatgttttcagttgtattagtaacttaattaattttcaatagctattcagtaatacttaatcttagaacattaattggatttgtttaatctttttttgttttttgttgatttatatgaacacagtcttgaggcagggacatggagaactatgcaagggtgatttctttgacttaatatatacaaggcctttacttctgtcccctaattcttccattgaatgtgtacctctaccttgtcatgtcatggaagatacaacatttggaagatctgacaattggaatgactttggaataataaaattgactaattggaaattttgcatattctgaaaa

SEQ ID NO: 31539 - DNA, 3587 bp, Homo sapiens
  misc_feature (3)..(3): n is a, c, g, or t
  misc_feature (7)..(7): n is a, c, g, or t
ggnaganggcggggctcaggtgcctggcagcgcggccggggcccaggaaggggagggggcgaacgctggagcgaggcgggggcgggtgaggagggggtgacgccggacgcgtcgacagcgcgagggttcgcgcgtgagctgcgcgggtcgggcctggtaccgagctttcctgggggctagcaggtcgtggacgccggctcctggaggagagccggtaggagggaggtgaaggtgtccgcggcgtcgtcgacggcggcgccggccatggaggagacgcagccgccgccgcagcctaagctgcccctgtgcgacagcctcatgatctggctgcagacattcaatactgcctcaccttgtcaagatgtcaaacagctgactagtggagttgccatggcacaagttcttcatcaaattgatgcagcttggtttaacgaatcttggttaagccgaattaaagaggatgttggggacaactggagaataaaggccagtaatgtaaagaaggtccttcaaggaattatgagttattatcatgagtttttggggcagcagatttcagaagcacttatccctgatttaaaccaaataaccgaatgttcagatccagtggagcttgggaggttgctccagcttattttaggttgtgcgatcaactgtgaaaagaagcaagaacatattcaaaatataatgacactggaagagtctgttcaacatgtggtcatgactgctattcaagagttgatgagtaaagaaatattgagctctcctccaaatgatgctgttggagaattggagcaacagcttaaaagagccttggaagaacttcaggaagcactagcagaaaaagaagagctgaggcaaagatgtgaagaattggatatgcaggtgactacacttcaagatgaaaagaattcactggtttctgaaaatgagatgatgaatgaaaaacttgaccagttggatggctcttttgatgatccaaacacagtggttgcaaaaaagtattttcatgcacaattacaactagaacaattacaggaagaaaacttcaggcttgaagctgcaaaagatgattaccgtgttcactgtgaagaacttgaaaagcagctaatcgaattccagcataggaatgatgaattgactagtcttgcagaagaaacaagagccctgaaagatgaaatagatgttcttagggctacctctgataaagcaaataaactggagtcaacagttgagatatatcgtcagaagctacaagatctgaatgaccttcgcaagcaggtgaaaactttacaggaaaccaacatgatgtatatgcataatacagtcagcttagaagaagaattaaaaaaagcaaatgcagcacgtacacaattagaaacatacaaaaggcaggttcaagatcttcatgttaaactttcctccgaatccaagagggcagacacactagcgtttgaaatgaagcggcttgaagaaaaacatgaagctttacttaaggaaaaagagagactaattgagcagcgtgatactttgaaagaaacaaatgaagagcttcgatgttcacaagtacaacaggaccacctaaaccaaacagatgcatctgctacaaaaagttatgagaatcttgctgctgagattatgccagtggaatatagggaggtgtttattcgactgcaacatgaaaataagatgcttcgcttacagcaagaaggctctgagaatgaacgtattgaggaacttcaggagcagctagaacagaaacaccgtaaaatgaatgaactggaaactgagcagaggctgagcaaagagcgtattagagaattgcagcagcagattgaggacctccagaaatctttacaggaacaaggttccaagtctgaaggcgaaagttccagcaaattaaagcagaagttggaagctcatatgtaagtaaaactgatatttcttttcaaatatgagaagggaggggttgtaaaagcctctaaagttaatctccttttcggattttgtctagaaaagcaaatatcctgatgctaattgatacacctgctgcaaaagtgaaaagcatgctaaagattcagcctccctactacccccgttccaaactcctacatctttccattgttaatatcatttgaaaagtttaaaaaaacagattaactatcacaactagattatatgggatgttaaacctataaaatattttactttcttaggaagcaagggtggcaagggaaataatttaacctttttggcacctgccgtgtgcctgactgtttacatcctcatgacaacccctggcagtcatgcagattagtattcccatttcacagatgaggaaccaagggtcagaaagcaacttgcccaaggtccacaaatgttatatggcagagaccagtctccatgctttttctaccacttagggaaaaactcacagaggtccatgaagaattacagaagaaacaagaactcattgaagatcttcagccagatataaatcaaaatgtacaaaagatcaatgaacttgaagctgctcttcagaagaaagatgaagatatgaaagcaatggaggaaagatataaaatgtacttggagaaagccagaaatgtaataaaaactttggatcccaagttaaatccagcatcagctgaaataatgctactaagaaagcagttggcagagaaagagagaagaattgagattctggagagtgaatgcaaagtagcaaaattccgtgattatgaagaaaaactcattgtttctgcgtggtataataagagtctagcattccagaaactggggatggaatctagacttgtgagcggcggtggtgcctgcagtgacactggtgcgtgcactcctgcgcggtctttcttagcgcagcaacggcacatcaccaacaccagaagaaatctctctgttaaagtccctgctacaacatctgattaaactgcaaaaaaaacaaaacaaaacaaaaaaacccacataaaatagaagtgtccttaaaatattttgtacctttcaactaactaccagattgaaaaagagtttatgatgcgggatatcaggtattttaaaatcaacatgcatcaaattaattttgccagttgactttaaaaacaaattatagaattagccatctctctgagggagcacatttgaataattggagatgcagttatacacacatttcaaacaaacatttgtcttttgagagtattataatttcaaattggccttgtatattttagttaaatgttttcagttgtattagtaacttaattaattttcaatagctattcagtaatacttaatcttagaacattaattggatttgtttaatctttttttgttttttgttgatttatatgaacacagtcttgaggcagggacatggagaactatgcaagggtgatttctttgacttaatatatacaaggcctttacttctgtcccctaattcttccattgaatgtgtacctctaccttgtcatgtcatggaagatacaacatttggaagatctgacaattggaatgactttggaataataaaattgactaattggaaattttgcatattctgaaaa

SEQ ID NO: 31540 - DNA, 3610 bp, Homo sapiens
  misc_feature (3)..(3): n is a, c, g, or t
  misc_feature (7)..(7): n is a, c, g, or t
ggnaganggcggggctcaggtgcctggcagcgcggccggggcccaggaaggggagggggcgaacgctggagcgaggcgggggcgggtgaggagggggtgacgccggacgcgtcgacagcgcgagggttcgcgcgtgagctgcgcgggtcgggcctggtaccgagctttcctgggggctagcaggtcgtggacgccggctcctggaggagagccggtaggagggaggtgaaggtgtccgcggcgtcgtcgacggcggcgccggccatggaggagacgcagccgccgccgcagcctaagctgcccctgtgcgacagcctcatgatctggctgcagacattcaatactgcctcaccttgtcaagatgtcaaacagctgactagtggagttgccatggcacaagttcttcatcaaattattttttttgttgttgtttcagtgatgcagcttggtttaacgaatcttggttaagccgaattaaagaggatgttggggacaactggagaataaaggccagtaatgtaaagaaggtccttcaaggaattatgagttattatcatgagtttttggggcagcagatttcagaagcacttatccctgatttaaaccaaataaccgaatgttcagatccagtggagcttgggaggttgctccagcttattttaggttgtgcgatcaactgtgaaaagaagcaagaacatattcaaaatataatgacactggaagagtctgttcaacatgtggtcatgactgctattcaagagttgatgagtaaagaaatattgagctctcctccaaatgatgctgttggagaattggagcaacagcttaaaagagccttggaagaacttcaggaagcactagcagaaaaagaagagctgaggcaaagatgtgaagaattggatatgcaggtgactacacttcaagatgaaaagaattcactggtttctgaaaatgagatgatgaatgaaaaacttgaccagttggatggctcttttgatgatccaaacacagtggttgcaaaaaagtattttcatgcacaattacaactagaacaattacaggaagaaaacttcaggcttgaagctgcaaaagatgattaccgtgttcactgtgaagaacttgaaaagcagctaatcgaattccagcataggaatgatgaattgactagtcttgcagaagaaacaagagccctgaaagatgaaatagatgttcttagggctacctctgataaagcaaataaactggagtcaacagttgagatatatcgtcagaagctacaagatctgaatgaccttcgcaagcaggtgaaaactttacaggaaaccaacatgatgtatatgcataatacagtcagcttagaagaagaattaaaaaaagcaaatgcagcacgtacacaattagaaacatacaaaaggcaggttcaagatcttcatgttaaactttcctccgaatccaagagggcagacacactagcgtttgaaatgaagcggcttgaagaaaaacatgaagctttacttaaggaaaaagagagactaattgagcagcgtgatactttgaaagaaacaaatgaagagcttcgatgttcacaagtacaacaggaccacctaaaccaaacagatgcatctgctacaaaaagttatgagaatcttgctgctgagattatgccagtggaatatagggaggtgtttattcgactgcaacatgaaaataagatgcttcgcttacagcaagaaggctctgagaatgaacgtattgaggaacttcaggagcagctagaacagaaacaccgtaaaatgaatgaactggaaactgagcagaggctgagcaaagagcgtattagagaattgcagcagcagattgaggacctccagaaatctttacaggaacaaggttccaagtctgaaggcgaaagttccagcaaattaaagcagaagttggaagctcatatgtaagtaaaactgatatttcttttcaaatatgagaagggaggggttgtaaaagcctctaaagttaatctccttttcggattttgtctagaaaagcaaatatcctgatgctaattgatacacctgctgcaaaagtgaaaagcatgctaaagattcagcctccctactacccccgttccaaactcctacatctttccattgttaatatcatttgaaaagtttaaaaaaacagattaactatcacaactagattatatgggatgttaaacctataaaatattttactttcttaggaagcaagggtggcaagggaaataatttaacctttttggcacctgccgtgtgcctgactgtttacatcctcatgacaacccctggcagtcatgcagattagtattcccatttcacagatgaggaaccaagggtcagaaagcaacttgcccaaggtccacaaatgttatatggcagagaccagtctccatgctttttctaccacttagggaaaaactcacagaggtccatgaagaattacagaagaaacaagaactcattgaagatcttcagccagatataaatcaaaatgtacaaaagatcaatgaacttgaagctgctcttcagaagaaagatgaagatatgaaagcaatggaggaaagatataaaatgtacttggagaaagccagaaatgtaataaaaactttggatcccaagttaaatccagcatcagctgaaataatgctactaagaaagcagttggcagagaaagagagaagaattgagattctggagagtgaatgcaaagtagcaaaattccgtgattatgaagaaaaactcattgtttctgcgtggtataataagagtctagcattccagaaactggggatggaatctagacttgtgagcggcggtggtgcctgcagtgacactggtgcgtgcactcctgcgcggtctttcttagcgcagcaacggcacatcaccaacaccagaagaaatctctctgttaaagtccctgctacaacatctgattaaactgcaaaaaaaacaaaacaaaacaaaaaaacccacataaaatagaagtgtccttaaaatattttgtacctttcaactaactaccagattgaaaaagagtttatgatgcgggatatcaggtattttaaaatcaacatgcatcaaattaattttgccagttgactttaaaaacaaattatagaattagccatctctctgagggagcacatttgaataattggagatgcagttatacacacatttcaaacaaacatttgtcttttgagagtattataatttcaaattggccttgtatattttagttaaatgttttcagttgtattagtaacttaattaattttcaatagctattcagtaatacttaatcttagaacattaattggatttgtttaatctttttttgttttttgttgatttatatgaacacagtcttgaggcagggacatggagaactatgcaagggtgatttctttgacttaatatatacaaggcctttacttctgtcccctaattcttccattgaatgtgtacctctaccttgtcatgtcatggaagatacaacatttggaagatctgacaattggaatgactttggaataataaaattgactaattggaaattttgcatattctgaaaa

SEQ ID NO: 31541 - DNA, 2165 bp, Homo sapiens
  misc_feature (3)..(3): n is a, c, g, or t
  misc_feature (7)..(7): n is a, c, g, or t
ggnaganggcggggctcaggtgcctggcagcgcggccggggcccaggaaggggagggggcgaacgctggagcgaggcgggggcgggtgaggagggggtgacgccggacgcgtcgacagcgcgagggttcgcgcgtgagctgcgcgggtcgggcctggtaccgagctttcctgggggctagcaggtcgtggacgccggctcctggaggagagccggtaggagggaggtgaaggtgtccgcggcgtcgtcgacggcggcgccggccatggaggagacgcagccgccgccgcagcctaagctgcccctgtgcgacagcctcatgatctggctgcagacattcaatactgcctcaccttgtcaagatgtcaaacagctgactagtggagttgccatggcacaagttcttcatcaaattgatgcagcttggtttaacgaatcttggttaagccgaattaaagaggatgttggggacaactggagaataaaggccagtaatgtaaagaaggtccttcaaggaattatgagttattatcatgagtttttggggcagcagatttcagaagcacttatccctgatttaaaccaaataaccgaatgttcagatccagtggagcttgggaggttgctccagcttattttaggttgtgcgatcaactgtgaaaagaagcaagaacatattcaaaatataatgacactggaagagtctgttcaacatgtggtcatgactgctattcaagagttgatgagtaaagaaatattgagctctcctccaaatgatgctgttggagaattggagcaacagcttaaaagagccttggaagaacttcaggaagcactagcagaaaaagaagagctgaggcaaagatgtgaagaattggatatgcaggtgactacacttcaagatgaaaagaattcactggtttctgaaaatgagatgatgaatgaaaaacttgaccagttggatggctcttttgatgatccaaacacagtggttgcaaaaaagtattttcatgcacaattacaactagaacaattacaggaagaaaacttcaggcttgaagctgcaaaagatgattaccgtgttcactgtgaagaacttgaaaagcagctaatcgaattccagcataggaatgatgaattgactagtcttgcagaagaaacaagagccctgaaagatgaaatagatgttcttagggctacctctgataaagcaaataaactggagtcaacagttgagatatatcgtcagaagctacaagatctgaatgaccttcgcaagcaggtgaaaactttacaggaaaccaacatgatgtatatgcataatacagtcagcttagaagaagaattaaaaaaagcaaatgcagcacgtacacaattagaaacatacaaaaggcaggttcaagatcttcatgttaaactttcctccgaatccaagagggcagacacactagcgtttgaaatgaagcggcttgaagaaaaacatgaagctttacttaaggaaaaagagagactaattgagcagcgtgatactttgaaagaaacaaatgaagagcttcgatgttcacaagtacaacaggaccacctaaaccaaacagatgcatctgctacaaaaagttatgagaatcttgctgctgagattatgccagtggaatatagggaggtgtttattcgactgcaacatgaaaataagatgcttcgcttacagcaagaaggctctgagaatgaacgtattgaggaacttcaggagcagctagaacagaaacaccgtaaaatgaatgaactggaaactgagcagaggtgatatgctccttagtaactgaaaatcttggtgattttattaccgagccataaaatcttgattcacagaaatggaaaatattattgtagctaaagtaattagaattacctagaaatagtttaatatttttgttagtagtctttcatcactataagcttctctctgtgaaagaagtcaggtgattcatttcagttatatttataaaatatatggataatccattaatttcagcattcttggttaaccaggctacttattctttttattctttttgagacagggtctccctctgtcgccactgcactccagcatgggaatcggggggtgaaaccctgtcaaaaaaacaaaacaaaacaaacaaacaaaca

SEQ ID NO: 31542 - DNA, 1943 bp, Homo sapiens
  misc_feature (3)..(3): n is a, c, g, or t
  misc_feature (7)..(7): n is a, c, g, or t
ggnaganggcggggctcaggtgcctggcagcgcggccggggcccaggaaggggagggggcgaacgctggagcgaggcgggggcgggtgaggagggggtgacgccggacgcgtcgacagcgcgagggttcgcgcgtgagctgcgcgggtcgggcctggtaccgagctttcctgggggctagcaggtcgtggacgccggctcctggaggagagccggtaggagggaggtgaaggtgtccgcggcgtcgtcgacggcggcgccggccatggaggagacgcagccgccgccgcagcctaagctgcccctgtgcgacagcctcatgatctggctgcagacattcaatactgcctcaccttgtcaagatgtcaaacagctgactagtggagttgccatggcacaagttcttcatcaaattgatgcagcttggtttaacgaatcttggttaagccgaattaaagaggatgttggggacaactggagaataaaggccagtaatgtaaagaaggtccttcaaggaattatgagttattatcatgagtttttggggcagcagatttcagaagcacttatccctgatttaaaccaaataaccgaatgttcagatccagtggagcttgggaggttgctccagcttattttaggttgtgcgatcaactgtgaaaagaagcaagaacatattcaaaatataatgacactggaagagtctgttcaacatgtggtcatgactgctattcaagagttgatgagtaaagaaatattgagctctcctccaaatgatgctgttggagaattggagcaacagcttaaaagagccttggaagaacttcaggaagcactagcagaaaaagaagagctgaggcaaagatgtgaagaattggatatgcaggtgactacacttcaagatgaaaagaattcactggtttctgaaaatgagatgatgaatgaaaaacttgaccagttggatggctcttttgatgatccaaacacagtggttgcaaaaaagtattttcatgcacaattacaactagaacaattacaggaagaaaacttcaggcttgaagctgcaaaagatgattaccgtgttcactgtgaagaacttgaaaagcagctaatcgaattccagcataggaatgatgaattgactagtcttgcagaagaaacaagagccctgaaagatgaaatagatgttcttagggctacctctgataaagcaaataaactggagtcaacagttgagatatatcgtcagaagctacaagatctgaatgaccttcgcaagcaggtgaaaactttacaggaaaccaacatgatgtatatgcataatacagtcagcttagaagaagaattaaaaaaagcaaatgcagcacgtacacaattagaaacatacaaaaggcaggttcaagatcttcatgttaaactttcctccgaatccaagagggcagacacactagcgtttgaaatgaagcggcttgaagaaaaacatgaagctttacttaaggaaaaagagagactaattgagcagcgtgatactttgaaagaaacaaatgaagagcttcgatgttcacaagtacaacaggaccacctaaaccaaacagatgcatctgctacaaaaagttatgagaatcttgctgctgagattatgccagtggaatatagggaggtgtttattcgactgcaacatgaaaataagatgcttcgcttacagcaagaaggctctgagaatgaacgtattgaggaacttcaggagcagctagaacagaaacaccgtaaaatgaatgaactggaaactgagcagaggctgagcaaagagcgtattagagaattgcagcagcagattgaggacctccagaaatctttacaggaacaaggttccaagtctgaaggcgaaagtaaatcgtctcatgcatggcggcatctcatatgtgcatatatacggtattgtaa

SEQ ID NO: 31543 - DNA, 1043 bp, Homo sapiens
gggcatgcatttgtgcttgattcagttaacatttgactacattgtgtgcctcacaagtgcaatctttagattctctcaataatgaacatagtgaagaaattattctatctttagtaatttggggtaatttctgggattttaattgttctcatatcttttttccagagtgaatgcaaagtagcaaaattccgtgattatgaagaaaaactcattgtttctgcgtggtataataagagtctagcattccagaaactggggatggaatctagacttgtgagcggcggtggtgcctgcagtgacactggtgcgtgcactcctgcgcggtctttcttagcgcagcaacggcacatcaccaacaccagaagaaatctctctgttaaagtccctgctacaacatctgattaaactgcaaaaaaaacaaaacaaaacaaaaaaacccacataaaatagaagtgtccttaaaatattttgtacctttcaactaactaccagattgaaaaagagtttatgatgcgggatatcaggtattttaaaatcaacatgcatcaaattaattttgccagttgactttaaaaacaaattatagaattagccatctctctgagggagcacatttgaataattggagatgcagttatacacacatttcaaacaaacatttgtcttttgagagtattataatttcaaattggccttgtatattttagttaaatgttttcagttgtattagtaacttaattaattttcaatagctattcagtaatacttaatcttagaacattaattggatttgtttaatctttttttgttttttgttgatttatatgaacacagtcttgaggcagggacatggagaactatgcaagggtgatttctttgacttaatatatacaaggcctttacttctgtcccctaattcttccattgaatgtgtacctctaccttgtcatgtcatggaagatacaacatttggaagatctgacaattggaatgactttggaataataaaattgactaattggaaattttgcatattctgaaaa

SEQ ID NO: 31544 - DNA, 138 bp, Homo sapiens
gttaaactttcctccgaatccaagagggcagacacactagcgtttgaaatgaagcggcttgaagaaaaacatgaagctttacttaaggaaaaagaggtaaacatagatataattgataaggaatatttcattgttctt

SEQ ID NO: 31545 - DNA, 323 bp, Homo sapiens
ctgttctctctgttgccttgtctacaccccataaattggcatggctcactcccttgctgtctacaggtacttgcacaaacttcaccttctcaatgaagtcttccctgactataatctatcatcttcatggattaatttttctccataaacacctccctgttgagtttttccacttagttcttattatttttcctaccccactaaaatacaaagttgaccaggtgcaatagctcacacctggaacctcaacactttgggggctcaaagtgggaggagtttgagaccaccctgggcagcatagtgagactctatctctaaaaaaa

SEQ ID NO: 31546 - DNA, 299 bp, Homo sapiens
tttattttgacctgggtatcagatactgtgctaagaactttagagtcagtatgttatttgattcttattaaaactcaataatgtagatatttgctcattttacagaagaggaaactaaatttagttaactgacttgcgcaaaggcacataggaagtggcactttaaaactttccaactcaggctgggcatggtgactcacacctgtaatcccagcactttgggtgggcaaggcaggcagatcacttgaggtcaggagttcgagacgagccttgccaacatagtgaaacacgatgtctgc

SEQ ID NO: 31547 - DNA, 191 bp, Homo sapiens
taaatgaaaacaagaaaaagttaaaaattgggggaacaaagttaaggtatagagtttctattagttgtctttttgcttctttgttcatccaaatagcatcattatcatcttaaaataatagattataaggtcatatatgctaagtctcaggttgatgacaaatgccaaaatttacaagggatacacaaaac

SEQ ID NO: 31548 - DNA, 440 bp, Homo sapiens
cataaaaaaattaaaggccacatgcagtgactcactcctgtaattccattactttgggaggctgaggtgggaggattgcttgagcctaggggtttgagaccagcctgagcaacatggcaagaccctgactctacaaacagtgaaacaattaacctggcctgggtgcagtggctcacgcgttaatcctaacattttgcaagggctacctaggtgggccgatgacttgagcctaggactttgagaccagcctgggcaacatggtgagaccccatctctacaaaaaatacagaagttaactgggtgagttgtgagcagctgtagtcccagctactcaggaggctgaggtgggaagatcacctgaacctgggaaggtttgaggctgcagtgagccatgattgaaccattgcactgcagcttgggtgacagactgagactctgta

SEQ ID NO: 31549 - DNA, 222 bp, Homo sapiens
gagaaaagaaataatacaaattagtcaccctagcctacatagcaagaccccgtctctacaaaaaataaaaaaaacttacccaggtgtggtggtacatgcttgtaaatcctagcttctcagtctccggagtagcttattaaccaatacacttctgaataatacataggccaaagaaaaacactcaaaaccagcctagggaaacatagtgataccccatttcta

SEQ ID NO: 31550 - DNA, 304 bp, Homo sapiens
cacagatgtttaaagcagctttatttataatggcccaaactgggaagaaaccaagatgtcttcagtggattacaggataaactatggtacatccacacaatagactattactcacctctagaaagaaaaaaaaaacaggccaggcatggtggctcacacctgtaatctcagcgttttggaaagcctaggcaagaggatcacttgaggcccggagttctagaccagcctgagcaaaatagcgaaacccaccccactgccccccttcatgtctaccaaaaaaataaaattgtttttagggtttttt

SEQ ID NO: 31551 - DNA, 400 bp, Homo sapiens
tttttgttaagacaagatctcctttgtcacccaagctggagtgtagtggcgcgatcatggctcattgcagcctcggtctcccaggctcaagcaatccttccacctcagcctccagactagctggaactacaggcacatatcaccaagcctggctaattttttaattaagacagggtctactatgtggcccaggctggtcttgaactcctggactcaagcaattctcccactctggcctcccaaagtgataggattacaggcatgagccaccacgcccagcctggctcacctctcttaactataaccataccaaatgaagaatgaataggaaggcgctatctccactttttgttcatttgtttcttttctcatatcctctgcagatgacgaagggagcaca

SEQ ID NO: 31552 - DNA, 478 bp, Homo sapiens
ggggattgtaactttgcatttctcccccaaccatcacctccactctctccccctccacccctcacctcccaaagcccctagccctcctcccctccctggcactggcccctgctccccacctaggccccctcagagaccagcctcagccaaaccagagaacgtgacccaactgtagaaataacagtgatggccgggcgcagtggctcatgcctgtaatcccagcactttgggaggccaaagcaggaggatcgcttgagcccaggagtttgagaccagcctgggcaacatagcaagaacccccttctctataaaaaattagccaggcattgtggcgcatgcctgtagtcccagctacttgggaggctgaggcagaaggattgcttgagcccaggaggtggaggctgcagtgagctatgatcacaccactgcactccaacccaggcgacagagagagaccctgtctctttaaaaaaaaaaa

SEQ ID NO: 31553 - DNA, 528 bp, Homo sapiens
ttcctgagtatcttctaacacctaacatgcataacataacataaagtttcaaaccaactttataatgtgccattcatctgaccctgccactattattaataacaggattgcattatatttcaaaatcttgggatttaagagctaaaaataaaaaagaccttacatatgctgtagggatggaaggaagactggtgttagatgggctatgggactaagactccctcccagagtttagagttagtatattcagctctcaacttcacatgtaagaaacctgagtctaggggggttaagtacctagacaaggtgatatgactttggatctggctcttcagttccacaaatatttcctgaccacctggcatatgtgaggcattcaagttcattttggtgaatgagaaaggatctgtgtgcttgggacatttccagtcaggaagagctagaggcctattcttcccgtgttaatataatcagtaggtgggatgatagaagagaataaaggaaaacaagaaatgctgccttgaggat

SEQ ID NO: 31554 - DNA, 334 bp, Homo sapiens
attttgctttgttgctgataaggagttttgcaggaagtgggaagagggtgaataactcaccaatccaaatatgaaataccattctcctgactcagaatcttccagatctgacactgcatcaaaacaaaatgtggcaaggcatgatggctcatgcctataatacgaacgcttttgagaggaggcggcaagaggcgtggtggggtaggtctgtagtcccagctactcaggaggctgaggcaagaagaccacttgagcccaggagttcaaggctgcaggaactgtgatcatgccaccacactccagcctgggagacagagtaagaccgtttctcaaa

SEQ ID NO: 31555 - DNA, 1005 bp, Homo sapiens
atgaatgaagacctgaaggtcaatttaagcgggctgcctcgggattatttagatgccgctgctgcggagaacatctcggctgctgtctcctcccgggttcctgccgtagagccagagcctgagctcgtagtcaacccctgggacattgtcttgtgtacctcgggaaccctcatctcctgtgaaaatgccattgtggtccttatcatcttccacaaccccagcctgcgagcacccatgttcctgctaataggcagcctggctcttgcagacctgctggccggcattggactcatcaccaattttgtttttgcctacctgcttcagtcagaagccaccaagctggtcacgatcggcctcattgtcgcctctttctctgcctctgtctgcagcttgctggctatcactgttgaccgctacctctcactgtactacgctctgacgtaccattcggagaggacggtcacgtttacctatgtcatgctcgtcatgctctgggggacctccatctgcctggggctgctgcccgtcatgggctggaactgcctccgagacgagtccacctgcagcgtggtcagaccgctcaccaagaacaacgcggccatcctctcggtgtccttcctcttcatgtttgcgctcatgcttcagctctacatccagatctgtaagattgtgatgaggcacgcccatcagatagccctgcagcaccacttcctggccacgtcgcactatgtgaccacccggaaaggggtctccaccctggctatcatcctggggacgtttgctgcttgctggatgcctttcaccctctattccttgatagcggattacacctacccctccatctatacctacgccaccctcctgcccgccacctacaattccatcatcaaccctgtcatatatgctttcagaaaccaagagatccagaaagcgctctgtctcatttgctgcggctgcatcccgtccagtctcgcccagagagcgcgctcgcccagtgatgtgtag

SEQ ID NO: 31556 - DNA, 344 bp, Homo sapiens
ctgaagtctgagctcatgaatttcaagtgcgaactctcagttgggttgtgcaattttcatcagtgatgttagcttagtgtaatgtgcagagaaggcaaatggggacgcttatctaggggtgaggttgtggcaagtgagtatgaaggatagagaataaggaaaaggagtcaagggtgggcaagacccattgagaataggttgaggctgtgggtttcctacattttcaaagtttgaaaagaagctgaaaagtctcagtctggtcctgatgaatgacatactttcacttgaaaactttggtttctcaatcctaaccaaagtgacccccccaaatgcaattgttgaga

SEQ ID NO: 31557 - DNA, 340 bp, Homo sapiens
caaataagaaagtggttgggtgctattgtaggtgctttgcaattatcaccttgctgatctcatccacttttattgtgtctcacttgagtgggagggaaagataggagaaaaaggagactaatgagaattattaatatatttacaagtgtatctactacatattaaagagctaaggtttagatgacatactgtatatttctaaatgactatttctgtttagaaattacattatttcatgactgggcagcattaaataaattatatggttctcaattcaaatcgtgggcaaaagggtttacttgtgcatgctgctgctttgtatctcaagtaacgtgattga

SEQ ID NO: 31558 - DNA, 630 bp, Homo sapiens
cctacacatggatatttattttgtcagagcagaagaaccacacaaaatcctgcacatggatatttgtcagagcataagaacttgagcacatggctatttatagcagctttattcataattgcaccaaacaagaagcaaccaagatgtctttcagtaggtaaatggatttttaaaaaaggtacattcatataatgaaatattatacagtgattaaaaagaaatgagtaatgaatctaggaaaacacacggaggaaccctacatgcatctgctgtgtgaaagaagccagtttgaaaaggctgcatattgtgtgattccaactacatgacattttggaaaaggctgaaactatagtgacagtcaaaagtccaggggtccagaggagagagaagggatgaacagctagaacacatggggttttcagggcagttaaattcttctgtgtgacactatataatggtggttaaattatgcatttgtcaaaactcaacaatgtacagcacaaagagtgaaccctaatgtaaactgtggatgttaataataatgtatccatatgaaacaattgctgatccttaaaaatgtaccacattttagctgttacttttccaagcacagctatatttaaaaaaaaa

SEQ ID NO: 31559 - DNA, 2007 bp, Homo sapiens
aattttcgtttcagtcgaatttgggctgataccttcttgaggcaaatgtctgaaattggttaagttatgttactgatgatttatactgattgtctctgctttattaaaatagctgtacttgggttaatatcttcttgtggcaaatatctataattggttatgaagctaataaccgatgaccttttccactgtttctgcttctgctttattaaaaccctcacatatttgctttatttccatttctttcttggcctgggagaaagggatttcttgctaatgatctgtggtgcagcgttgtgccgccagtacttacttgtattatgacactgctggcaatggctgctcttagactcttgagtgtttggggccaattttcaaaaggtcctaatcaagaacacaaaattcctgcatgtgatttgaattaggttcaaaatggtcaaatacaagttcagtctgaaaatgcacacgcctgtaagagtgtatcttaattgtactcaaagttagctccttactcctcaggaagtggaaacccctgaatgaaactgactttgtgtgtgaatttctcactttctgaatccagttcagtgtgtccagagaggcatgtgcttacaacatagatagtttttttcagatgtagttgtatttgttaagatttttttggttgtaaatgatagaaaccaactctaatttgagcaaaagccagcatttattggctcataactgggaattctaaagggtcaagttggagtcaggtataactatatgtacagggactataatcaatcatgtcatcaatcacttctcaatttttctctgtctcacagttttgaattcattctcaaggcatggccaccggcagttcaaggcgtacctcagccttacagttataatcttccatagctccagcaaaagtcccaggggagacctgattaacccacttgggtcacagagccttgtcagaaccagtcattgtggccaggagcatggagtgctctgattggtcaatctgggtcacatgcccacccttgttgagggtaaggaaggaggtttaggaattatcttaccacatggaattggttacctataagaatgaggagttctgatgtcgagagaaagaacaacagaggatgtgaagccactgaaagcttgactcagggaaaagaaatgtgggaccatcacacacatgaaaatggctataatcctcactgtattttcttgttcttcttgaaaaatataggatttgattccacagttcttcttgactttttgatttcatcagaaacctgttttcttgaatattttgttagatatttaaaattactgcaaaaggactgggataattttttcaccatttgcaataactttgatgcaactgaatctaaatatgacataagtatttgtggctgtgtcccctcacttgtccaaggaccaaagctccaaccaaacaataccccatcgtttgactgctcctcatagtcacagagatgtgtgtgctcggcactcctgggcttccgatgctccctctgaaccactgaaagctgtgatgtccaagggggctcacaccatgtgtgcttctagtctgtcttccccccgggcctctcaaagtctggtagattacgacagctctgacgattctgacgtggaatccacagagcagtgtttagctaacagtaaacagacatctttacaccagcaagcaactaaggagattcaggatgcagctgggacaagcagggataaaaaagaatttagccttgagcctccatcaaggcctctggttctgaaagaatttgatactgccttctcctttgattgtgaagtagccccaaatgatgtcgtctctgaagtgggaatattttacagaatagtaaaatgcttccaggaactacaagatgccatctgccgtttgcaaaagaaaaatcttttcccatataatccaactgcacttttgaagttgttaaaatacatagaggtgataagtaataaaactatgaacactttgtaaaa

SEQ ID NO: 31560 - DNA, 3689 bp, Homo sapiens
cggtggcccagagcgggcatttgtgttccctcaaatggcggtgtgaagagagttcgcctgagccagatcccaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaaagaaatctttaaagattcatgttcacagaaaacagaaattctaaagcagttcctgactcatttcgacaccatttttgaagtgttttacaattccttattctctcagcattttgaaaactgccgggatacttctaaaatagtaaacatcctgatgtgtttcctggatttgcttgagcttctcatcgcctccagaatccacctgaagttacatttcacttgccagaggattttatttttgaaaccatcttgcatgctagaagttattacctggcctattcaggcttttgttaaaaggaaggtcatcatattcctcaaaaagtgccttctctgtaaagtgggtgaagacctctgtcgtggatctgtgcctgccttaatgccgccagaccatcatgtagcggtggacatgctggctttagctaatgctgttttgcaagctgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaaatgaaaggtgcgtgaccatggcccactgcagccctgaccccccttcggcccatgctattcctcctgtcccaacctgggaggtcctggcctgggagatcaaggctacagtgagccgcgacccatcgcacacctgcactccagtcctggtgcaacagatggagatcctttcagggagagagagagagagagaggagaagacagagagattaaagaaaaatatgttcactcccacttatgtgtttattgttattattgtttgttgttatttctttgttattgttgtgtttactgtttatttattttgaggcagggtcttgctctgtctcccaggctcactgcagcctcaacgttttgagctgaagtgatcctctcgcctctgcttccccaccccatttgtattaatccttcatacaattagtgtttctactaatgtagattattgaaaattagatattgaattaaagctaatatatgagaagttatattgacaaagaaattgttacatatataatttccagaatagtaactcaggagttcaaagtcttccattttacttgagaaaaatgaatagtaaatgtctctaaacaggcagcatacagattcagtgaaaagtttgaattgtgagcaatgacatcactgaattgctttggatataatttagcttttaataactacacattagttataattctgtgcagttttaatttataacactagatggcacctgttatataattcagttttaaattgtagttcaaactacctaaaacgtttttttatttttgtgcttaataatagtacttctatgctttaaacaaacaaaaaatatgtttttctgttattttgaagacaaaattatttttgcttggttgcattcttggacagacagctctggcatccgatgaagtgatcttagttgtctgctcatttatttatctgcttttagcaagaaatcacataacttttatttctaagagacagttgttaggcagttgttgcaaatagatgatgtagctgtacattttaaatgtatgctctggaatgagtcactttttttccctgagcctcagtgtcctcatttgccaaataaagatgcttcctaactgattcctgatgactttttgaaagtgaattaggataattgcatcttaaggtactttagacactatgaatttatatataggcaagatattcattcattcataaactattgcctacactttgaaattttcattttttgaagttgacttacagaggttcatgtctgagttactgaccttcttaaagcctcatcttcagccctctctgcaattacacaatccgtgcaaatggctgtctcgggttttcatagaacaagacgatgacatgctggaggctgccaaggcatcactgggcatctacttaacactgaccagaggatgtgaagccactgaaagcttgactcagggaaaagaaatgtgggaccatcacacacatgaaaatggctataatcctcactgtattttcttgttcttcttgaaaaatataggatttgattccacagttcttcttgactttttgatttcatcagaaacctgttttcttgaatattttgttagatatttaaaattactgcaaaaggactgggataattttttcaccatttgcaataactttgatgcaactgaatctaaatatgacataagtatttgtggctgtgtcccctcacttgtccaaggaccaaagctccaaccaaacaataccccatcgtttgactgctcctcatagtcacagagatgtgtgtgctcggcactcctgggcttccgatgctccctctgaaccactgaaagctgtgatgtccaagggggctcacaccatgtgtgcttctagtctgtcttccccccgggcctctcaaagtctggtagattacgacagctctgacgattctgacgtggaatccacagagcagtgtttagctaacagtaaacagacatctttacaccagcaagcaactaaggagattcaggatgcagctgggacaagcagggataaaaaagaatttagccttgagcctccatcaaggcctctggttctgaaagaatttgatactgccttctcctttgattgtgaagtagccccaaatgatgtcgtctctgaagtgggaatattttacagaatagtaaaatgcttccaggaactacaagatgccatctgccgtttgcaaaagaaaaatcttttcccatataatccaactgcacttttgaagttgttaaaatacatagaggtgataagtaataaaactatgaacactttgtaaaa

SEQ ID NO: 31561 - DNA, 3892 bp, Homo sapiens
cggtggcccagagcgggcatttgtgttccctcaaatggcggtgtgaagagagttcgcctgagccagatcccaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaaagaaatctttaaagattcatgttcacagaaaacagaaattctaaagcagttcctgactcatttcgacaccatttttgaagtgttttacaattccttattctctcagcattttgaaaactgccgggatacttctaaaatagtaaacatcctgatgtgtttcctggatttgcttgagcttctcatcgcctccagaatccacctgaagttacatttcacttgccagaggattttatttttgaaaccatcttgcatgctagaagttattacctggcctattcaggcttttgttaaaaggaaggtcatcatattcctcaaaaagtgccttctctgtaaagtgggtgaagacctctgtcgtggatctgtgcctgccttaatgccgccagaccatcatgtagcggtggacatgctggctttagctaatgctgttttgcaagctgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaaatgaaaggtgcgtgaccatggcccactgcagccctgaccccccttcggcccatgctattcctcctgtcccaacctgggaggtcctggcctgggagatcaaggctacagtgagccgcgacccatcgcacacctgcactccagtcctggtgcaacagatggagatcctttcagggagagagagagagagagaggagaagacagagagattaaagaaaaatatgttcactcccacttatgtgtttattgttattattgtttgttgttatttctttgttattgttgtgtttactgtttatttattttgaggcagggtcttgctctgtctcccaggctcactgcagcctcaacgttttgagctgaagtgatcctctcgcctctgcttccccaccccatttgtattaatccttcatacaattagtgtttctactaatgtagattattgaaaattagatattgaattaaagctaatatatgagaagttatattgacaaagaaattgttacatatataatttccagaatagtaactcaggagttcaaagtcttccattttacttgagaaaaatgaatagtaaatgtctctaaacaggcagcatacagattcagtgaaaagtttgaattgtgagcaatgacatcactgaattgctttggatataatttagcttttaataactacacattagttataattctgtgcagttttaatttataacactagatggcacctgttatataattcagttttaaattgtagttcaaactacctaaaacgtttttttatttttgtgcttaataatagtacttctatgctttaaacaaacaaaaaatatgtttttctgttattttgaagacaaaattatttttgcttggttgcattcttggacagacagctctggcatccgatgaagtgatcttagttgtctgctcatttatttatctgcttttagcaagaaatcacataacttttatttctaagagacagttgttaggcagttgttgcaaatagatgatgtagctgtacattttaaatgtatgctctggaatgagtcactttttttccctgagcctcagtgtcctcatttgccaaataaagatgcttcctaactgattcctgatgactttttgaaagtgaattaggataattgcatcttaaggtactttagacactatgaatttatatataggcaagatattcattcattcataaactattgcctacactttgaaattttcattttttgaagttgacttacagaggttcatgtctgagttactgaccttcttaaagcctcatcttcagccctctctgcaattacacaatccgtgcaaatggctgtctcgggttttcatagaacaagacgatgacatgctggaggctgccaaggcatcactgggcatctacttaacactgaccagaggatgtgaagccactgaaagcttgactcagggaaaagaaatgtgggaccatcacacacatgaaaatggctataatcctcactgtattttcttgttcttcttgaaaaatataggatttgattccacagttcttcttgactttttgatttcatcagaaacctgttttcttgaatattttgttagatatttaaaattactgcaaaaggactgggataattttttcaccatttgcaataactttgatgcaactgaatctaaatatgacataagtatttgtggctgtgtcccctcacttgtccaaggaccaaagctccaaccaaacaataccccatcgtttgactgctcctcatagtcacagagatgtgtgtgctcggcactcctgggcttccgatgctccctctgaaccactgaaagctgtgatgtccaagggggctcacaccatgtgtgcttctagtctgtcttccccccgggcctctcaaagtctggtagattacgacagctctgacgattctgacgtggaatccacagagcagtgtttagctaacagtaaacagacatctttacaccagcaagcaactaaggagattcaggatgcagctgggacaagcagggataaaaaagaatttagccttgagcctccatcaaggcctctggttctgaaagaatttgatactgccttctcctttgattgtgaagtagccccaaatgatgtcgtctctgaagtgggaatattttacagaatagtaaaatgcttccaggaactacaagatgccatctgccgtttgcaaaagaaaaatcttttcccatataatccaactgcacttttgaagttgttaaaatacatagaggtgataagtaataaaactatgaacactttgtaaaacattgacattttattttccaggtattgtttttccttaatataaattatgtctcaatgaggtaatagtataaaatcatcaccataaaagggttttcttttttttttttttttttgagacagaatctcattctgtcgctcaggccggagtgcagtggcgtgactcgactcactgcaacctccacctcctgggttcaagcaattct

SEQ ID NO: 31562 - DNA, 3721 bp, Homo sapiens
cggtggcccagagcgggcatttgtgttccctcaaatggcggtgtgaagagagttcgcctgagccagatcccaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaaagaaatctttaaagattcatgttcacagaaaacagaaattctaaagcagttcctgactcatttcgacaccatttttgaagtgttttacaattccttattctctcagcattttgaaaactgccgggatacttctaaaatagtaaacatcctgatgtgtttcctggatttgcttgagcttctcatcgcctccagaatccacctgaagttaacaatttaaattgaccaagaaggataaaattataaaagaaaaacatattgaactgaataggaagtatatatacacatggaatattacaaggctataaagtaaaaaaaggaaagggtaataatatataaataaaaaaagctgaaataatatgattaaaaatgggtgaagacctctgtcgtggatctgtgcctgccttaatgccgccagaccatcatgtagcggtggacatgctggctttagctaatgctgttttgcaagctgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaaatgaaaggtgcgtgaccatggcccactgcagccctgaccccccttcggcccatgctattcctcctgtcccaacctgggaggtcctggcctgggagatcaaggctacagtgagccgcgacccatcgcacacctgcactccagtcctggtgcaacagatggagatcctttcagggagagagagagagagagaggagaagacagagagattaaagaaaaatatgttcactcccacttatgtgtttattgttattattgtttgttgttatttctttgttattgttgtgtttactgtttatttattttgaggcagggtcttgctctgtctcccaggctcactgcagcctcaacgttttgagctgaagtgatcctctcgcctctgcttccccaccccatttgtattaatccttcatacaattagtgtttctactaatgtagattattgaaaattagatattgaattaaagctaatatatgagaagttatattgacaaagaaattgttacatatataatttccagaatagtaactcaggagttcaaagtcttccattttacttgagaaaaatgaatagtaaatgtctctaaacaggcagcatacagattcagtgaaaagtttgaattgtgagcaatgacatcactgaattgctttggatataatttagcttttaataactacacattagttataattctgtgcagttttaatttataacactagatggcacctgttatataattcagttttaaattgtagttcaaactacctaaaacgtttttttatttttgtgcttaataatagtacttctatgctttaaacaaacaaaaaatatgtttttctgttattttgaagacaaaattatttttgcttggttgcattcttggacagacagctctggcatccgatgaagtgatcttagttgtctgctcatttatttatctgcttttagcaagaaatcacataacttttatttctaagagacagttgttaggcagttgttgcaaatagatgatgtagctgtacattttaaatgtatgctctggaatgagtcactttttttccctgagcctcagtgtcctcatttgccaaataaagatgcttcctaactgattcctgatgactttttgaaagtgaattaggataattgcatcttaaggtactttagacactatgaatttatatataggcaagatattcattcattcataaactattgcctacactttgaaattttcattttttgaagttgacttacagaggttcatgtctgagttactgaccttcttaaagcctcatcttcagccctctctgcaattacacaatccgtgcaaatggctgtctcgggttttcatagaacaagacgatgacatgctggaggctgccaaggcatcactgggcatctacttaacactgaccagaggatgtgaagccactgaaagcttgactcagggaaaagaaatgtgggaccatcacacacatgaaaatggctataatcctcactgtattttcttgttcttcttgaaaaatataggatttgattccacagttcttcttgactttttgatttcatcagaaacctgttttcttgaatattttgttagatatttaaaattactgcaaaaggactgggataattttttcaccatttgcaataactttgatgcaactgaatctaaatatgacataagtatttgtggctgtgtcccctcacttgtccaaggaccaaagctccaaccaaacaataccccatcgtttgactgctcctcatagtcacagagatgtgtgtgctcggcactcctgggcttccgatgctccctctgaaccactgaaagctgtgatgtccaagggggctcacaccatgtgtgcttctagtctgtcttccccccgggcctctcaaagtctggtagattacgacagctctgacgattctgacgtggaatccacagagcagtgtttagctaacagtaaacagacatctttacaccagcaagcaactaaggagattcaggatgcagctgggacaagcagggataaaaaagaatttagccttgagcctccatcaaggcctctggttctgaaagaatttgatactgccttctcctttgattgtgaagtagccccaaatgatgtcgtctctgaagtgggaatattttacagaatagtaaaatgcttccaggaactacaagatgccatctgccgtttgcaaaagaaaaatcttttcccatataatccaactgcacttttgaagttgttaaaatacatagaggtgataagtaataaaactatgaacactttgtaaaa

SEQ ID NO: 31563 - DNA, 3798 bp, Homo sapiens
cggtggcccagagcgggcatttgtgttccctcaaatggcggtgtgaagagagttcgcctgagccagatcccagttttaacaagggaggcatgagacatcaatcaagatatgtaaaatgaacattggttcagtccagaaaggtgggacaactcttaagctgggagggggcttccaggtcacaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaaagaaatctttaaagattcatgttcacagaaaacagaaattctaaagcagttcctgactcatttcgacaccatttttgaagtgttttacaattccttattctctcagcattttgaaaactgccgggatacttctaaaatagtaaacatcctgatgtgtttcctggatttgcttgagcttctcatcgcctccagaatccacctgaagttacatttcacttgccagaggattttatttttgaaaccatcttgcatgctagaagttattacctggcctattcaggcttttgttaaaaggaaggtcatcatattcctcaaaaagtgccttctctgtaaagtgggtgaagacctctgtcgtggatctgtgcctgccttaatgccgccagaccatcatgtagcggtggacatgctggctttagctaatgctgttttgcaagctgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaaatgaaaggtgcgtgaccatggcccactgcagccctgaccccccttcggcccatgctattcctcctgtcccaacctgggaggtcctggcctgggagatcaaggctacagtgagccgcgacccatcgcacacctgcactccagtcctggtgcaacagatggagatcctttcagggagagagagagagagagaggagaagacagagagattaaagaaaaatatgttcactcccacttatgtgtttattgttattattgtttgttgttatttctttgttattgttgtgtttactgtttatttattttgaggcagggtcttgctctgtctcccaggctcactgcagcctcaacgttttgagctgaagtgatcctctcgcctctgcttccccaccccatttgtattaatccttcatacaattagtgtttctactaatgtagattattgaaaattagatattgaattaaagctaatatatgagaagttatattgacaaagaaattgttacatatataatttccagaatagtaactcaggagttcaaagtcttccattttacttgagaaaaatgaatagtaaatgtctctaaacaggcagcatacagattcagtgaaaagtttgaattgtgagcaatgacatcactgaattgctttggatataatttagcttttaataactacacattagttataattctgtgcagttttaatttataacactagatggcacctgttatataattcagttttaaattgtagttcaaactacctaaaacgtttttttatttttgtgcttaataatagtacttctatgctttaaacaaacaaaaaatatgtttttctgttattttgaagacaaaattatttttgcttggttgcattcttggacagacagctctggcatccgatgaagtgatcttagttgtctgctcatttatttatctgcttttagcaagaaatcacataacttttatttctaagagacagttgttaggcagttgttgcaaatagatgatgtagctgtacattttaaatgtatgctctggaatgagtcactttttttccctgagcctcagtgtcctcatttgccaaataaagatgcttcctaactgattcctgatgactttttgaaagtgaattaggataattgcatcttaaggtactttagacactatgaatttatatataggcaagatattcattcattcataaactattgcctacactttgaaattttcattttttgaagttgacttacagaggttcatgtctgagttactgaccttcttaaagcctcatcttcagccctctctgcaattacacaatccgtgcaaatggctgtctcgggttttcatagaacaagacgatgacatgctggaggctgccaaggcatcactgggcatctacttaacactgaccagaggatgtgaagccactgaaagcttgactcagggaaaagaaatgtgggaccatcacacacatgaaaatggctataatcctcactgtattttcttgttcttcttgaaaaatataggatttgattccacagttcttcttgactttttgatttcatcagaaacctgttttcttgaatattttgttagatatttaaaattactgcaaaaggactgggataattttttcaccatttgcaataactttgatgcaactgaatctaaatatgacataagtatttgtggctgtgtcccctcacttgtccaaggaccaaagctccaaccaaacaataccccatcgtttgactgctcctcatagtcacagagatgtgtgtgctcggcactcctgggcttccgatgctccctctgaaccactgaaagctgtgatgtccaagggggctcacaccatgtgtgcttctagtctgtcttccccccgggcctctcaaagtctggtagattacgacagctctgacgattctgacgtggaatccacagagcagtgtttagctaacagtaaacagacatctttacaccagcaagcaactaaggagattcaggatgcagctgggacaagcagggataaaaaagaatttagccttgagcctccatcaaggcctctggttctgaaagaatttgatactgccttctcctttgattgtgaagtagccccaaatgatgtcgtctctgaagtgggaatattttacagaatagtaaaatgcttccaggaactacaagatgccatctgccgtttgcaaaagaaaaatcttttcccatataatccaactgcacttttgaagttgttaaaatacatagaggtgataagtaataaaactatgaacactttgtaaaa

SEQ ID NO: 31564 - DNA, 2250 bp, Homo sapiens
aattttcgtttcagtcgaatttgggctgataccttcttgaggcaaatgtctgaaattggttaagttatgttactgatgatttatactgattgtctctgctttattaaaatagctgtacttgggttaatatcttcttgtggcaaatatctataattggttatgaagctaataaccgatgaccttttccactgtttctgcttctgctttattaaaaccctcacatatttgctttatttccatttctttcttggcctgggagaaagggatttcttgctaatgatctgtggtgcagcgttgtgccgccagtacttacttgtattatgacactgctggcaatggctgctcttagactcttgagtgtttggggccaattttcaaaaggtcctaatcaagaacacaaaattcctgcatgtgatttgaattaggttcaaaatggtcaaatacaagttcagtctgaaaatgcacacgcctgtaagagtgtatcttaattgtactcaaagttagctccttactcctcaggaagtggaaacccctgaatgaaactgactttgtgtgtgaatttctcactttctgaatccagttcagtgtgtccagagaggcatgtgcttacaacatagatagtttttttcagatgtagttgtatttgttaagatttttttggttgtaaatgatagaaaccaactctaatttgagcaaaagccagcatttattggctcataactgggaattctaaagggtcaagttggagtcaggtataactatatgtacagggactataatcaatcatgtcatcaatcacttctcaatttttctctgtctcacagttttgaattcattctcaaggcatggccaccggcagttcaaggcgtacctcagccttacagttataatcttccatagctccagcaaaagtcccaggggagacctgattaacccacttgggtcacagagccttgtcagaaccagtcattgtggccaggagcatggagtgctctgattggtcaatctgggtcacatgcccacccttgttgagggtaaggaaggaggtttaggaattatcttaccacatggaattggttacctataagaatgaggagttctgatgtcgagagaaagaacaacagataacttttattgggcagacaaaaactagaactgccaaagtcagtggattttgctttactgagtcagatttctttagagcttatggggaagggaatgggttttgaaattttttcttttaagaagtgatgcatagatttaaaagtaatctaataggttaatttatggtatgtgaattatatctggtaaaactgtttatttttgtaaggtcattaatctgcattctccattatcttcattttcagaggatgtgaagccactgaaagcttgactcagggaaaagaaatgtgggaccatcacacacatgaaaatggctataatcctcactgtattttcttgttcttcttgaaaaatataggatttgattccacagttcttcttgactttttgatttcatcagaaacctgttttcttgaatattttgttagatatttaaaattactgcaaaaggactgggataattttttcaccatttgcaataactttgatgcaactgaatctaaatatgacataagtatttgtggctgtgtcccctcacttgtccaaggaccaaagctccaaccaaacaataccccatcgtttgactgctcctcatagtcacagagatgtgtgtgctcggcactcctgggcttccgatgctccctctgaaccactgaaagctgtgatgtccaagggggctcacaccatgtgtgcttctagtctgtcttccccccgggcctctcaaagtctggtagattacgacagctctgacgattctgacgtggaatccacagagcagtgtttagctaacagtaaacagacatctttacaccagcaagcaactaaggagattcaggatgcagctgggacaagcagggataaaaaagaatttagccttgagcctccatcaaggcctctggttctgaaagaatttgatactgccttctcctttgattgtgaagtagccccaaatgatgtcgtctctgaagtgggaatattttacagaatagtaaaatgcttccaggaactacaagatgccatctgccgtttgcaaaagaaaaatcttttcccatataatccaactgcacttttgaagttgttaaaatacatagaggtgataagtaataaaactatgaacactttgtaaaa

SEQ ID NO: 31565 - DNA, 1557 bp, Homo sapiens
cggtggcccagagcgggcatttgtgttccctcaaatggcggtgtgaagagagttcgcctgagccagatcccaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaaagaaatctttaaagattcatgttcacagaaaacagaaattctaaagcagttcctgactcatttcgacaccatttttgaagtgttttacaattccttattctctcagcattttgaaaactgccgggatacttctaaaatagtaaacatcctgatgtgtttcctggatttgcttgagcttctcatcgcctccagaatccacctgaagttacatttcacttgccagaggattttatttttgaaaccatcttgcatgctagaagttattacctggcctattcaggcttttgttaaaaggaaggtcatcatattcctcaaaaagtgccttctctgtaaagtgggtgaagacctctgtcgtggatctgtgcctgccttaatgccgccagaccatcatgtagcggtggacatgctggctttagctaatgctgttttgcaagctgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaaatgaaaggtaattctccaaactccttttgtatgcagtgtgtaattatttacttaagtacagtaattcataattatcaaatctcaggactagtttaaattccagtaatttaagctgtatgttatcctatttgtaacttattacattttcaaaaaaaaaaaaaagaac

SEQ ID NO: 31566 - DNA, 3724 bp, Homo sapiens
cggtggcccagagcgggcatttgtgttccctcaaatggcggtgtgaagagagttcgcctgagccagatcccaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaaagaaatctttaaagattcatgttcacagaaaacagaaattctaaagcagttcctgactcatttcgacaccatttttgaagtgttttacaattccttattctctcagcattttgaaaactgccgggatacttctaaaatagtaaacatcctgatgtgtttcctggatttgcttgagcttctcatcgcctccagaatccacctgaagttacatttcacttgccagaggattttatttttgaaaccatcttgcatgctagaagttattacctggcctattcaggcttttgttaaaaggaaggtcatcatattcctcaaaaagtgccttctctgtaaagtgggtgaagacctctgtcgtggatctgtgcctgccttaatgccgccagaccatcatgtagcggtggacatgctggctttagctaatgctgttttgcaagctgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaaatgaaaggtgcgtgaccatggcccactgcagccctgaccccccttcggcccatgctattcctcctgtcccaacctgggaggtcctggcctgggagatcaaggctacagtgagccgcgacccatcgcacacctgcactccagtcctggtgcaacagatggagatcctttcagggagagagagagagagagaggagaagacagagagattaaagaaaaatatgttcactcccacttatgtgtttattgttattattgtttgttgttatttctttgttattgttgtgtttactgtttatttattttgaggcagggtcttgctctgtctcccaggctcactgcagcctcaacgttttgagctgaagtgatcctctcgcctctgcttccccaccccatttgtattaatccttcatacaattagtgtttctactaatgtagattattgaaaattagatattgaattaaagctaatatatgagaagttatattgacaaagaaattgttacatatataatttccagaatagtaactcaggagttcaaagtcttccattttacttgagaaaaatgaatagtaaatgtctctaaacaggcagcatacagattcagtgaaaagtttgaattgtgagcaatgacatcactgaattgctttggatataatttagcttttaataactacacattagttataattctgtgcagttttaatttataacactagatggcacctgttatataattcagttttaaattgtagttcaaactacctaaaacgtttttttatttttgtgcttaataatagtacttctatgctttaaacaaacaaaaaatatgtttttctgttattttgaagacaaaattatttttgcttggttgcattcttggacagacagctctggcatccgatgaagtgatcttagttgtctgctcatttatttatctgcttttagcaagaaatcacataacttttatttctaagagacagttgttaggcagttgttgcaaatagatgatgtagctgtacattttaaatgtatgctctggaatgagtcactttttttccctgagcctcagtgtcctcatttgccaaataaagatgcttcctaactgattcctgatgactttttgaaagtgaattaggataattgcatcttaaggtactttagacactatgaatttatatataggcaagatattcattcattcataaactattgcctacactttgaaattttcattttttgaagttgacttacagaggttcatgtctgagttactgaccttcttaaagcctcatcttcagccctctctgcaattacacaatccgtgcaaatggctgtctcgggttttcatagaacaagacgatgacatgctggaggctgccaaggcatcactgggcatctacttaacactgaccagaggatgtgaagccactgaaagcttgactcagggaaaagaaatgtgggaccatcacacacatgaaaatggctataatcctcactgtattttcttgttcttcttgaaaaatataggatttgattccacagttcttcttgactttttgatttcatcagaaacctgttttcttgaatattttgttagatatttaaaattactgcaaaaggactgggataattttttcaccatttgcaataactttgatgcaactgaatctaaatatgacataagtatttgtggctgtgtcccctcacttgtccaaggaccaaagctccaaccaaacaataccccatcgtttgactgctcctcatagtcacagagatgtgtgtgctcggcactcctgggcttccgatgctccctctgaaccactgaaagctgtgatgtccaagggggctcacaccatgtgtgcttctagtctgtcttccccccgggcctctcaaagtctggtagattacgacagctctgacgattctgacgtggaatccacagagcagtgtttagctaacagtaaacagacatctttacaccagcaagcaactaaggagattcaggatgcagctgggacaagcagggataaaaaagaatttagccttgagcctccatcaaggcctctggttctgaaagaatttgatactgccttctcctttgattgtgaagtagccccaaatgatgtcgtctctgaagtgggaatattttacagaatagtaaaatgcttccaggaactacaagatgccatctgccgtttgcaaaagaaaaatcttttcccatataatccaactgcacttttgaagttgttaaaatacatagaggtgataagtaataaaactatgaacactttgtaaaaaaaaatctaataatataaaactcctagggggggct

SEQ ID NO: 31567 - DNA, 2453 bp, Homo sapiens
cggtggcccagagcgggcatttgtgttccctcaaatggcggtgtgaagagagttcgcctgagccagatcccaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaaagaaatctttaaagattcatgttcacagaaaacagaaattctaaagcagttcctgactcatttcgacaccatttttgaagtgttttacaattccttattctctcagcattttgaaaactgccgggatacttctaaaatagtaaacatcctgatgtgtttcctggatttgcttgagcttctcatcgcctccagaatccacctgaagttacatttcacttgccagaggattttatttttgaaaccatcttgcatgctagaagttattacctggcctattcaggcttttgttaaaaggaaggtcatcatattcctcaaaaagtgccttctctgtaaagtgggtgaagacctctgtcgtggatctgtgcctgccttaatgccgccagaccatcatgtagcggtggacatgctggctttagctaatgctgttttgcaagctgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaaatgaaagttgacttacagaggttcatgtctgagttactgaccttcttaaagcctcatcttcagccctctctgcaattacacaatccgtgcaaatggctgtctcgggttttcatagaacaagacgatgacatgctggaggctgccaaggcatcactgggcatctacttaacactgaccagaggatgtgaagccactgaaagcttgactcagggaaaagaaatgtgggaccatcacacacatgaaaatggctataatcctcactgtattttcttgttcttcttgaaaaatataggatttgattccacagttcttcttgactttttgatttcatcagaaacctgttttcttgaatattttgttagatatttaaaattactgcaaaaggactgggataattttttcaccatttgcaataactttgatgcaactgaatctaaatatgacataagtatttgtggctgtgtcccctcacttgtccaaggaccaaagctccaaccaaacaataccccatcgtttgactgctcctcatagtcacagagatgtgtgtgctcggcactcctgggcttccgatgctccctctgaaccactgaaagctgtgatgtccaagggggctcacaccatgtgtgcttctagtctgtcttccccccgggcctctcaaagtctggtagattacgacagctctgacgattctgacgtggaatccacagagcagtgtttagctaacagtaaacagacatctttacaccagcaagcaactaaggagattcaggatgcagctgggacaagcagggataaaaaagaatttagccttgagcctccatcaaggcctctggttctgaaagaatttgatactgccttctcctttgattgtgaagtagccccaaatgatgtcgtctctgaagtgggaatattttacagaatagtaaaatgcttccaggaactacaagatgccatctgccgtttgcaaaagaaaaatcttttcccatataatccaactgcacttttgaagttgttaaaatacatagaggtgataagtaataaaactatgaacactttgtaaaa

SEQ ID NO: 31568 - DNA, 921 bp, Homo sapiens
gcaccctacagatgcgggtctccgcccagccgcggtcacctggggggctgggggcggggcctgggcggggcggggttcggccgggagcgcagggcggcagtgcgcgcctagcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccgggaaaaaaacaaaaaaaaaaacaaaaaaaaaaaccgggggtttttggggggggaaaaaaatatagaagggcgggagttcgcacactttttgagagggaacagggcccaaagggagagaaaaaggcagcggagac

SEQ ID NO: 31569 - DNA, 875 bp, Homo sapiens
atcccccctcgactagcccgacaggggggttcggccgggagcgcagggcggcagtgcgcgcctagcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccgggaaaaaaacaaaaaaaaaaacaaaaaaaaaaaccgggggtttttggggggggaaaaaaatatagaagggcgggagttcgcacactttttgagagggaacagggcccaaagggagagaaaaaggcagcggagac

SEQ ID NO: 31570 - DNA, 789 bp, Homo sapiens
gcaccctacagatgcgggtctccgcccagccgcggtcacctggggggctgggggcggggcctgggcggggcggggttcggccgggagcgcagggcggcagtgcgcgcctagcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31571 - DNA, 1028 bp, Homo sapiens
gcaccctacagatgcgggtctccgcccagccgcggtcacctggggggctgggggcggggcctgggcggggcggggttcggccgggagcgcagggcggcagtgcgcgcctagcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccgggaaaaaaacaaaaaaaaaaacaaaaaaaaaaaaaaaattggagaggcgcatctatggccggggggcgcggagagaaaggaggcgtactagaatgtggcgcacgtgggccaatacagcgtgttccctgagacccaagttttcttggcacaacggcggtggagaactccggcagggtcccccctatagggaggccgaataaattcgataagccaggtaacctggtatgacaccggcaaaagc

SEQ ID NO: 31572 - DNA, 1055 bp, Homo sapiens
gcaccctacagatgcgggtctccgcccagccgcggtcacctggggggctgggggcggggcctgggcggggcggggttcggccgggagcgcagggcggcagtgcgcgcctagcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccgggaaaaaaacaaaaaaaaaaacaaaaaaaaaaaaaaaaaaaaaaaaaaaaaaaaaaaaaaacaaaaaaaaacacgccgcgggacacattatatgggcggggggcaaaaaacgcagcggtcagacaagggcaggccgccggcccaaacgtgctggctcagcgcacccacgatctttttgacaaagagagggaacactgcgcggcgccacccccagcgagaggggggccacaacaatgccaacaaccgcgcgagaacccgcgtgtaaggg

SEQ ID NO: 31573 - DNA, 690 bp, Homo sapiens
tctcaaatcaaccgaacatccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31574 - DNA, 3333 bp, Homo sapiens
gcaccctacagatgcgggtctccgcccagccgcggtcacctggggggctgggggcggggcctgggcggggcggggttcggccgggagcgcagggcggcagtgcgcgcctagcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcatttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccccagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaacctttaaacactggggatgccttcatgctttctggtgagggtctgttaacttggcgcgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggtcttcaagctctccccccaccacccccatgtgcagaaatgcctgggcacccttggggggctgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31575 - DNA, 2647 bp, Homo sapiens
gcaccctacagatgcgggtctccgcccagccgcggtcacctggggggctgggggcggggcctgggcggggcggggttcggccgggagcgcagggcggcagtgcgcgcctagcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactgagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccccagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaacctttaaacactggggatgccttcatgctttctggtgagggtctgttaacttggcgcgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggtcttcaagctctccccccaccacccccatgtgcagaaatgcctgggcacccttggggggctgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31576 - DNA, 3990 bp, Homo sapiens
atcccccctcgactagcccgacaggggggttcggccgggagcgcagggcggcagtgcgcgcctagcagtgtcccagccgggttcgtgtcgccatggggcagatcgagtgggccatgtgggccaacgagcaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagcgcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacggtcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcatttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccccagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaacctttaaacactggggatgccttcatgctttctggtgagggtctgttaacttggcgcgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggtcttcaagctctccccccaccacccccatgtgcagaaatgcctgggcacccttggggggctgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31577 - DNA, 3371 bp, Homo sapiens
atcccccctcgactagcccgacaggggggttcggccgggagcgcagggcggcagtgcgcgcctagcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctggcctgtgtctgctgtctagtgtgcaggatttgtaaggatccactccaaatccgaggagctccgatccgtcgccagggtctggggctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcatttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccccagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaacctttaaacactggggatgccttcatgctttctggtgagggtctgttaacttggcgcgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggtcttcaagctctccccccaccacccccatgtgcagaaatgcctgggcacccttggggggctgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31578 - DNA, 4395 bp, Homo sapiens
atcccccctcgactagcccgacaggggggttcggccgggagcgcagggcggcagtgcgcgcctagcagtgtcccagccgggttcgtgtcgccatggggcagatcgagtgggccatgtgggccaacgagcaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagcgcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacggtcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctggcctgtgtctgctgtctagtgtgcaggatttgtaaggatccactccaaatccgaggagctccgatccgtcgccagggtctggggtcagcatgcactgctggggggtcttgcctgggcttcctggtagggtggagggttccgtgctgtgtgtctgctggttactgccggctgaggccaggacacccacacgtggctgcttcctccgagcaagtgcaccagagccgctagtgtccacatcaaggctgagaacacccaggaccgaaacaagccccggtccgcgcacgtcccctgggtctgcagtctgccttgtcctgagactttgtggccttggcccccagacctggggctccgttcccctttctgagtgcccttctgtgtccctgcctctcacccgctgtcccccagctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcatttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccccagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaacctttaaacactggggatgccttcatgctttctggtgagggtctgttaacttggcgcgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggtcttcaagctctccccccaccacccccatgtgcagaaatgcctgggcacccttggggggctgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31579 - DNA, 3361 bp, Homo sapiens
atcgactgccactggatgtttatcgatgccactgggtgtttatcgatgccactggtgtttatcgatgccacgtccaggtcactccggtagcagcgtctgccctcagatgcaaggagatcgtccagccacgccctgatttgctgagcctgttaaggctgaacaggagagccctaggtgacgggcctagaaacttccgtaggaagccccatgggcagcttgggtggtcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcatttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccccagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaacctttaaacactggggatgccttcatgctttctggtgagggtctgttaacttggcgcgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggtcttcaagctctccccccaccacccccatgtgcagaaatgcctgggcacccttggggggctgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31580 - DNA, 3901 bp, Homo sapiens
tctcaaatcaaccgaacatccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggtgagtcccctcctgctctggggtctctccgggggttgcggggcccaggcagggctcacagggttgggtggagcttggtttctcacttggaggctccggaaccaaccctttggtgcttgtgggtaaaccaaggccggtgcctgcccggtgtgttttgtgggaggaaagaggcctgggtgccctggggtggtcagcagggcagcaaaggagtcccgagtgggagaggcccagccgcgccgtctcgccttcctccctcccccaggggacagaagcacatgaccgccgtggtgaagctgttcgggccctttaccaggaattactatgttcgggccgtcctgcatctcctggcctgtgtctgctgtctagtgtgcaggatttgtaaggatccactccaaatccgaggagctccgatccgtcgccagggtctggggtcagcatgcactgctggggggtcttgcctgggcttcctggtagggtggagggttccgtgctgtgtgtctgctggttactgccggctgaggccaggacacccacacgtggctgcttcctccgagcaagtgcaccagagccgctagtgtccacatcaaggctgagaacacccaggaccgaaacaagccccggtccgcgcacgtcccctgggtctgcagtctgccttgtcctgagactttgtggccttggcccccagacctggggctccgttcccctttctgagtgcccttctgtgtccctgcctctcacccgctgtcccccagctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcatttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccccagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaacctttaaacactggggatgccttcatgctttctggtgagggtctgttaacttggcgcgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggtcttcaagctctccccccaccacccccatgtgcagaaatgcctgggcacccttggggggctgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31581 - DNA, 3274 bp, Homo sapiens
gcaccctacagatgcgggtctccgcccagccgcggtcacctggggggctgggggcggggcctgggcggggcggggttcggccgggagcgcagggcggcagtgcgcgcctagcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcatttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccccagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaacctttaaacactggggatgccttcatgctttctggtgagggtctgttaacttggcgcgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggttgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31582 - DNA, 3177 bp, Homo sapiens
atgaggggttccaccatggagcgctggggacagaagcacatgaccgccgtggtgaagctgttcgggccctttaccaggaattactatgttcgggccgtcctgcatctcctgctctcggtgcccgccggcttcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcatttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccccagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaacctttaaacactggggatgccttcatgctttctggtgagggtctgttaacttggcgcgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggtcttcaagctctccccccaccacccccatgtgcagaaatgcctgggcacccttggggggctgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31583 - DNA, 1764 bp, Homo sapiens
  misc_feature (29)..(29): n is a, c, g, or t
  misc_feature (43)..(43): n is a, c, g, or t
  misc_feature (45)..(45): n is a, c, g, or t
  misc_feature (48)..(48): n is a, c, g, or t
  misc_feature (58)..(58): n is a, c, g, or t
ccaaacctttaacggtggccttcttcttnccttcccccccaancnggncccttttggnccccccaaaggtttttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaacctttaaacactggggatgccttcatgctttctggtgagggtctgttaacttggcgcgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggtcttcaagctctccccccaccacccccatgtgcagaaatgcctgggcacccttggggggctgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31584 - DNA, 1446 bp, Homo sapiens
atcccccctcgactagcccgacaggggggttcggccgggagcgcagggcggcagtgcgcgcctagcagtgtcccagccgggttcgtgtcgccatggggcagatcgagtgggccatgtgggccaacgagcaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagcgcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacggtcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31585 - DNA, 2158 bp, Homo sapiens
  misc_feature (980)..(980): n is a, c, g, or t
atcccccctcgactagcccgacaggggggttcggccgggagcgcagggcggcagtgcgcgcctagcagtgtcccagccgggttcgtgtcgccatggggcagatcgagtgggccatgtgggccaacgagcaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagcgcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacgggtgaggctgggctcaggcgaggtctgagggcagaggcaccactgcagcagctccaggaaggacctgcaccgggggaggagtgcctgggaagggcctgggggctgagggtgaggaggaggggcccgcngccaccactcccctggggctctgagcgccctccctgttgtctggagggtgcgtggcagctggagtgggagcagagacctcagggtgggagggctggaggacggggccctgcagcctgtcctgtgcccaggaaagtgaccgcctgcttcgagtcagcggccaagaagtcggtgggtcagttcagacagctctccccagagctgccccgtgagactcaccctgcctgccccgcactccctacaggaagtagacggactgagggcacccagctgggagccaggagacctgggctctagtctggcctcctgctgaaaccctccaggggctcctggcccgaagagttagagccagactggacgccctgcactgcccgccctggcctcccggctctccggccccctcctccagctgccgtgcttcctttctgttcctagatctcctgagcgtgccccagggcctcggcacaagctgctgcttctgcagagcctcatggctgtctcatttatttctcaattcaaatgccacctgcctggggaggtccttccagaccgtgcagccccaggaggcagctggcccggagacagcagggccttgacaaagagtcccccctgtacacagcaggtgctctgtaaatgtggctgggtgccagaatacgtcctcagacctccctggtggcaccagcggcagctttgcaccctctttcggatggcaggctcgggaccaggacggtccccaaagatgcatggacaattggctgagtagactcaaggacactgccctcccctcctccgacgcagacagacaaacccagagagttaatgtgtagctgggctcaaaccaaggataggaaatcttccaacaagaccatgtggagacaaaaacagaatggctggcagggcaaggtggctacacctgtaatcctagcactttgggaggccaaggcgggcggatcacgaggtcaggagatcgagaccatcctggctaacacagtgaaaccccgtctctactaaaaatacaaaaaattagccgggtatggtggcaggcgcgcatagtcccagctactcgggaggctgaggcaggagaatcgcttcaacctgggaggtggaggttgtagtgagctgagatcacgccacggaactccagcctgggtgacagggcaagactctgtctccaaaaaaa

SEQ ID NO: 31586 - DNA, 1923 bp, Homo sapiens
gcaccctacagatgcgggtctccgcccagccgcggtcacctggggggctgggggcggggcctgggcggggcggggttcggccgggagcgcagggcggcagtgcgcgcctagcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcatttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccccagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagaatcgcttcaacctgggaggtggaggttgtagtgagctgagatcacgccacggaactccagcctgggtgacagggcaagaatctgtctcca

SEQ ID NO: 31587 - DNA, 2439 bp, Homo sapiens
  misc_feature (980)..(980): n is a, c, g, or t
atcccccctcgactagcccgacaggggggttcggccgggagcgcagggcggcagtgcgcgcctagcagtgtcccagccgggttcgtgtcgccatggggcagatcgagtgggccatgtgggccaacgagcaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagcgcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacgggtgaggctgggctcaggcgaggtctgagggcagaggcaccactgcagcagctccaggaaggacctgcaccgggggaggagtgcctgggaagggcctgggggctgagggtgaggaggaggggcccgcngccaccactcccctggggctctgagcgccctccctgttgtctggagggtgcgtggcagctggagtgggagcagagacctcagggtgggagggctggaggacggggccctgcagcctgtcctgtgcccaggaaagtgaccgcctgcttcgagtcagcggccaagaagtcggtgggtcagttcagacagctctccccagagctgccccgtgagactcaccctgcctgccccgcactccctacaggaagtagacggactgagggcacccagctgggagccaggagacctgggctctagtctggcctcctgctgaaaccctccaggggctcctggcccgaagagttagagccagactggacgccctgcactgcccgccctggcctcccggctctccggccccctcctccagctgccgtgcttcctttctgttcctagatctcctgagcgtgccccagggcctcggcacaagctgctgcttctgcagagcctcatggctgtctcatttatttctcaattcaaatgccacctgcctggggaggtccttccagaccgtgcagccccaggaggcagctggcccggagacagcagggccttgacaaagagtcccccctgtacacagcaggtgctctgtaaatgtggctgggtgccagaatacgtcctcagacctccctggtggcaccagcggcagctttgcaccctctttcggatggcaggctcgggaccaggacggtccccaaagatgcatggacaattggctgagtagactcaaggacactgccctcccctcctccgacgcagacagacaaacccagagagttaatgtgtagtggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31588 - DNA, 550 bp, Homo sapiens
gcaccctacagatgcgggtctccgcccagccgcggtcacctggggggctgggggcggggcctgggcggggcggggttcggccgggagcgcagggcggcagtgcgcgcctagcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactgcggctgctgatggtgccacgatctgcgccgctcccgatcgtgc

SEQ ID NO: 31589 - DNA, 633 bp, Homo sapiens
atgaggggttccaccatggagcgctggggacagaagcacatgaccgccgtggtgaagctgttcgggccctttaccaggaattactatgttcgggccgtcctgcatctcctgctctcggtgcccgccggcttcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31590 - DNA, 952 bp, Homo sapiens
tctcaaatcaaccgaacatccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggtgagtcccctcctgctctggggtctctccgggggttgcggggcccaggcagggctcacagggttgggtggagcttggtttctcacttggaggctccggaaccaaccctttggtgcttgtgggtaaaccaaggccggtgcctgcccggtgtgttttgtgggaggaaagaggcctgggtgccctggggtggtcagcagggcagcaaaggagtcccgagtgggagaggcccagccgcgccgtctcgccttcctccctcccccaggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31591 - DNA, 1851 bp, Homo sapiens
atcccccctcgactagcccgacaggggggttcggccgggagcgcagggcggcagtgcgcgcctagcagtgtcccagccgggttcgtgtcgccatggggcagatcgagtgggccatgtgggccaacgagcaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagcgcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacggtcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctggcctgtgtctgctgtctagtgtgcaggatttgtaaggatccactccaaatccgaggagctccgatccgtcgccagggtctggggtcagcatgcactgctggggggtcttgcctgggcttcctggtagggtggagggttccgtgctgtgtgtctgctggttactgccggctgaggccaggacacccacacgtggctgcttcctccgagcaagtgcaccagagccgctagtgtccacatcaaggctgagaacacccaggaccgaaacaagccccggtccgcgcacgtcccctgggtctgcagtctgccttgtcctgagactttgtggccttggcccccagacctggggctccgttcccctttctgagtgcccttctgtgtccctgcctctcacccgctgtcccccagctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31592 - DNA, 1824 bp, Homo sapiens
atcccccctcgactagcccgacaggggggttcggccgggagcgcagggcggcagtgcgcgcctagcagtgtcccagccgggttcgtgtcgccatggggcagatcgagtgggccatgtgggccaacgagcaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagcgcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacggtcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctggcctgtgtctgctgtctagtgtgcaggatttgtaaggatccactccaaatccgaggagctccgatccgtcgccagggtctggggtcagcatgcactgctggggggtcttgcctgggcttcctggtagggtggagggttccgtgctgtgtgtctgctggttactgccggctgaggccaggacacccacacgtggctgcttcctccgagcaagtgcaccagagccgctagtgtccacatcaaggctgagaacacccaggaccgaaacaagccccgtctgccttgtcctgagactttgtggccttggcccccagacctggggctccgttcccctttctgagtgcccttctgtgtccctgcctctcacccgctgtcccccagctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31593 - DNA, 606 bp, Homo sapiens
tctcaaatcaaccgaacatccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaatgcagcgaagccggg

SEQ ID NO: 31594 - DNA, 1120 bp, Homo sapiens
atcccccctcgactagcccgacaggggggttcggccgggagcgcagggcggcagtgcgcgcctagcagtgtcccagccgggttcgtgtcgccatggggcagatcgagtgggccatgtgggccaacgagcaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagcgcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacggtcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgttgggatcactctagatcaacctcagcatcagtgcac

SEQ ID NO: 31595 - DNA, 360 bp, Homo sapiens
ccgccgtggtgaagctgttcgggccctttaccaggaattactatgttcgggccgtcctgcatctccttgtgagtccccgtcccgcaccccctctagggctcaggagggcttggagccgaccctccccactgtcccaccggccgggctgcctggacaggagccaccccccacttacctcagtgtttttccaaacaaaaattcgggtccctggctctggcagggcctgtgtctgctgtctagtgtgcaggatttgtaaggatccactccaaatccgaggagctccgatccgtcgccagggtctggggtcagcatgcactgctggggggtcttgcctgggcttcctggtagggtggagggttc

SEQ ID NO: 31596 - DNA, 838 bp, Homo sapiens
ggcgcgcggcgcggggcggaaaagcctgtttacacagactgcacaccgcctggggaataatgcagtaaaggaagtgagccggctcggcctgactgctccaacttcctgctctcacacacaccagaggggaaaaaaaaagaggagcgagagaaagaaaaaaagggggaaaaatcaggatctcattacaagagccacagaccgtctgcagacgcctgtcagcatggaaagtcgggggctttcgcccgggtcctcctagaaattccccccgaagaagactcccccacatctggaagaccagtatggtgctgtgaaatgttgcaaaacatgacctgatgacaacccaaaacacttcatagaaaactatccaagaatgtgacttcctggagtagagtcttttttcactgagggtgagttgctgcttactaatcgttagttttgttgccttccaattctaaggaatgactcagtcatctccatgtttcccagacctggacttcctcatgaaactttatttttttaattgtttatgttgccagggctggccttgcactcctgggctcaagtgatgctcccacctcagcctccgcagtagctggggttacaggtgtgaacctctgtaccagctgtctcattaaagtttaaaagaaatgggctgtctgtccattctggctttgttctggctgtagagcccagatgactgtcttctgaccctttcctaaggttctgtacataaatacgcagatgagaggggaaggggactccatttttgttagattttcttgtatgtttcaggcaaaagttttttatgtcctggttatctttaattcctctttgcctg

SEQ ID NO: 31597 - DNA, 4181 bp, Homo sapiens
ggcgcgcggcgcggggcggaaaagcctgtttacacagactgcacaccgcctggggaataatgcagtaaaggaagtgagccggctcggcctgactgctccaacttcctgctctcacacacaccagaggggaaaaaaaaagaggagcgagagaaagaaaaaaagggggaaaaatcaggatctcattacaagagccacagaccgtctgcagacgcctgtcagcatggaaagtcgggggctttcgcccgggtcctcctagaaattccccccgaagaagactcccccacatctgggtatggagagtgcaatcacgctgtggcagttcctgttgcagttgctgctggatcagaaacatgagcatttgatctgctggacctcgaacgatggtgaattcaagctcctcaaagcagaagaagtggccaagctgtggggactccgaaaaaacaaaacaaatatgaactatgataagctgagcagagccctgcgatactattatgacaagaacatcatcaagaaggtgatcgggcagaagtttgtgtacaagtttgtctctttcccggagatcctgaagatggatcctcacgcggtggagatcagccgggagagccttctgctgcaggacagcgactgcaaggcgtctccggagggccgcgaggcccacaaacacggcctggccgccctcagaagcacgagccgcaacgaatacatccactcaggcctgtactcgtccttcaccattaattccctgcagaacccaccagacgccttcaaggccatcaagacggagaagctggaggagccgcccgaagacagcccccccgtggaagaagtcaggactgtgatcaggtttgtgaccaataaaaccgacaagcacgtcaccaggccggtggtgtccctgccttccacgtcagaggctgcggcggcgtccgccttcctggcctcgtccgtctcggccaagatctcctctttaatgttgccaaacgctgccagtatttcatccgcctcacccttctcatctcggtccccgtccctgtcccccaactcacccctcccttctgaacacagaagcctcttcctggaggccgcctgccatgactccgattccctggagcccttgaacctgtcatcgggctccaagaccaagtctccatctcttcccccaaaggccaaaaaacccaaaggcttggaaatctcagcgcccccgctggtgctctccggcaccgacatcggctccatcgccctcaacagcccagccctcccctcgggatccctcaccccagccttcttcaccgcacagacaccaaatggattgcttctgactccgagtccactgctctccagcatacatttctggagcagccttagtccagttgctccgctgagtcctgccaggctgcaagggccaagcacgctgttccagttccccacactgcttaatggccacatgccagtgccaatccccagtctggacagagctgcttctccagtactgctttcttcaaactctcagaaatcctgatgacgtctggccacaattaaggactcattaactgatgaaacaaatttgtccccacgggctagtttacctgtgtcgtgagaaggacattgtgaaactcttgttaatttggtttgcacttttcataacatggatagtctagatttatgttagcattttaaaaactgtttttgatatattcaagtatatatgaaaatctgtttggcattaagtgaattttaatgtttttgtttttatatccttttagctcttaagtgttgaacactgttgacagtgaagaacttttcttaatggttttcagtataactaataaggatgtgaagcttttttctctttagttctgagtatgctaaactgtgtgcttatatagactataaccagttgtgccttccttcgcatttaatgtaaatgaatgatttatatattttttagtattaagaggaaatgtttgaaagatgaaaattagtatcaaacagctctctagtagaatttcattatttttcaccagtgggcaatatgaaagcatatatcacgttttgttttactttcaattgtataagaattgccttagaacctcttttgaactgaaattcagtaaatgtccaagtaatgtttttataataaactaagccatatttagacaataaacattgataaaatgttctaaagtacattttcaaaagaatggaccttgaaaggctagcctccttagctgtttacagtatcttatcttttagatgcctcccagacaaaaatctgagatggaaaagctacatcaagttcatgctattccaggcccaagaatatctcctaggttagcatattcttatttcaaaaaattagccctggttttctcagttttccatagggaatcccgaccatctgatatatttactgtgtcagtataagtaagttggggttcccctggaactataattaacatttaaaaaatctaatgctttagaagaagctcacagagtggtgatgaacccaaacaacaaagaaaccatttttaacactaggtatcttcatcagtataggtaggtgttcacaatttttgatggatcaaaaacttgctgtaatacaaatagagagtggaggtactaaaggccttgcttgtggaaactgagagaggatacactgctttatgtattactaaagttaggggagaatgaaggaaatctgacagatgaaaaattctacaggaacctcatcatcgtggaactgaactgatgataacttggaacactccagtaaattctgttgtgtaatgtaatttggagcagtgataatacagacatattttctgttccatcagaaaatcagcaggcaccagtccaaaggtaccacacctgtacatgaagaaggaaagttctaatacaagaaaactgaaaagcaccaagctttaaattcaagattaattacaatccttaactataagtgatgataaaaactaacttgaaatgtgactaaataactgatccaaactgggcattaagtggcaggattatgagaaaggataaaaaaagagatttgagaaaacacatttcttgaattttcagaaaaaaatctagactattgctttgacacttagaaattctgaggtttttcaattggaattgagcatctctgtatgtggggatgtgggcccttatcaagggataaaaatccaaacactctaacatgcctccttgactgtaaagtaatgacactggttccaaaattcacaaataatagacactactgtccccccacccccaccccataggctaagaataattctgtaccagaataaaaggagctggtccagggaactgatatttactgaacatacaaagttagtgctagaaggggcctttgagaatgcttcccgccacctgtttccagctcaagacaggtgcacagcagaagctgggagttgcctatggctgcacagctcactgaaggtagaacaatgattggtgctcagtccaattctgtctcccccatgcctagctgttaagtaattactggttcaaaactacgtgttattagtaaaacaaacaaaacagataaagacagcatttaaaactgtgttgtcagataagagaacacatccaaaatgcatgattcttacaaactaaaggaagttaatgtgcaaaaatctcaaccaaaactactatttttagtatacttgtttacgtaaatgctgattggaaatatttaaatgactatagatctgattctttcttttcctttggaaactgggattaatgtatgctctagatccatttattagaaatgcaaaaatactacaattttttgatggatgaaaatactcctgtaacacaaacagagaactggaggaactgaagaataactcactcatatagctctgcctcattctgtgtgtgtgtgcatgtgtgtgttagcagaggtattttactcagaaaataggtttcaaagaacattaatgactttcttttcccttttatgtctgcttaatcagtgttaaactgctatgggaaaagttttatagaactatataacctgaatgttggtctctttgtacacatcttttctatgactgcaaatcttcactttatgtatcatttttactgtcatattatttttgttcaataaaaactttgtgataaaaggtgtttagaggtaactggattggcttact

SEQ ID NO: 31598 - DNA, 2967 bp, Homo sapiens
gagggagcgttgaaggactgttgggttagaatgcctgttcctccgtgcatatgaggaaagctcaggacacatcaaagcaaacaccaaatggattgcttctgactccgagtccactgctctccagcatacatttctggagcagccttagtccagttgctccgctgagtcctgccaggctgcaagggccaagcacgctgttccagttccccacactgcttaatggccacatgccagtgccaatccccagtctggacagagctgcttctccagtactgctttcttcaaactctcagaaatcctgatgacgtctggccacaattaaggactcattaactgatgaaacaaatttgtccccacgggctagtttacctgtgtcgtgagaaggacattgtgaaactcttgttaatttggtttgcacttttcataacatggatagtctagatttatgttagcattttaaaaactgtttttgatatattcaagtatatatgaaaatctgtttggcattaagtgaattttaatgtttttgtttttatatccttttagctcttaagtgttgaacactgttgacagtgaagaacttttcttaatggttttcagtataactaataaggatgtgaagcttttttctctttagttctgagtatgctaaactgtgtgcttatatagactataaccagttgtgccttccttcgcatttaatgtaaatgaatgatttatatattttttagtattaagaggaaatgtttgaaagatgaaaattagtatcaaacagctctctagtagaatttcattatttttcaccagtgggcaatatgaaagcatatatcacgttttgttttactttcaattgtataagaattgccttagaacctcttttgaactgaaattcagtaaatgtccaagtaatgtttttataataaactaagccatatttagacaataaacattgataaaatgttctaaagtacattttcaaaagaatggaccttgaaaggctagcctccttagctgtttacagtatcttatcttttagatgcctcccagacaaaaatctgagatggaaaagctacatcaagttcatgctattccaggcccaagaatatctcctaggttagcatattcttatttcaaaaaattagccctggttttctcagttttccatagggaatcccgaccatctgatatatttactgtgtcagtataagtaagttggggttcccctggaactataattaacatttaaaaaatctaatgctttagaagaagctcacagagtggtgatgaacccaaacaacaaagaaaccatttttaacactaggtatcttcatcagtataggtaggtgttcacaatttttgatggatcaaaaacttgctgtaatacaaatagagagtggaggtactaaaggccttgcttgtggaaactgagagaggatacactgctttatgtattactaaagttaggggagaatgaaggaaatctgacagatgaaaaattctacaggaacctcatcatcgtggaactgaactgatgataacttggaacactccagtaaattctgttgtgtaatgtaatttggagcagtgataatacagacatattttctgttccatcagaaaatcagcaggcaccagtccaaaggtaccacacctgtacatgaagaaggaaagttctaatacaagaaaactgaaaagcaccaagctttaaattcaagattaattacaatccttaactataagtgatgataaaaactaacttgaaatgtgactaaataactgatccaaactgggcattaagtggcaggattatgagaaaggataaaaaaagagatttgagaaaacacatttcttgaattttcagaaaaaaatctagactattgctttgacacttagaaattctgaggtttttcaattggaattgagcatctctgtatgtggggatgtgggcccttatcaagggataaaaatccaaacactctaacatgcctccttgactgtaaagtaatgacactggttccaaaattcacaaataatagacactactgtccccccacccccaccccataggctaagaataattctgtaccagaataaaaggagctggtccagggaactgatatttactgaacatacaaagttagtgctagaaggggcctttgagaatgcttcccgccacctgtttccagctcaagacaggtgcacagcagaagctgggagttgcctatggctgcacagctcactgaaggtagaacaatgattggtgctcagtccaattctgtctcccccatgcctagctgttaagtaattactggttcaaaactacgtgttattagtaaaacaaacaaaacagataaagacagcatttaaaactgtgttgtcagataagagaacacatccaaaatgcatgattcttacaaactaaaggaagttaatgtgcaaaaatctcaaccaaaactactatttttagtatacttgtttacgtaaatgctgattggaaatatttaaatgactatagatctgattctttcttttcctttggaaactgggattaatgtatgctctagatccatttattagaaatgcaaaaatactacaattttttgatggatgaaaatactcctgtaacacaaacagagaactggaggaactgaagaataactcactcatatagctctgcctcattctgtgtgtgtgtgcatgtgtgtgttagcagaggtattttactcagaaaataggtttcaaagaacattaatgactttcttttcccttttatgtctgcttaatcagtgttaaactgctatgggaaaagttttatagaactatataacctgaatgttggtctctttgtacacatcttttctatgactgcaaatcttcactttatgtatcatttttactgtcatattatttttgttcaataaaaactttgtgataaaaggtgtttagaggtaactggattggcttact

SEQ ID NO: 31599 - DNA, 3496 bp, Homo sapiens
gttgcaagtagtcacatattaaaaggccttgttcagttgggattgcaactaacatatttgtttcagacctgaaactcattatcagagcatatactgtcatcctactatatttatcatcttagtgaacaacaatacagaaatcttattctttgtcacttatgagtgatctgtgtgatattttaattagaatactttcttagctccaaaataatctattctaaatctttaaatacatttcttactttagaataaatgctgcaagaatcatctttgtagtaccctgaaaaactgatggcaaatttcaaaatatagtattagaaattactgactcacatgtaaagagtctatggttttcaaaacactcttttaatatttaatattaaacattattttaatatttatagcattatcagcatcctgagtagcttagaacttttaaaaaatagtgttagaagatgctttagcaacatataaattatatattttttcctagtagcctatgcatatagaataattagggacattttctgggccttatcctttgtttgctctatgtaaatcttgatctcattgtcatcttccaattattctgtaaaatacattggcaactaatctctatcacaggggtgatgagagaaatggactgctatggactgtatgggaatgtaaagaacctaagttcttcccaatggatttgcaataattattgtaaaaatcttttgtcccctacagttccccacactgcttaatggccacatgccagtgccaatccccagtctggacagagctgcttctccagtactgctttcttcaaactctcagaaatcctgatgacgtctggccacaattaaggactcattaactgatgaaacaaatttgtccccacgggctagtttacctgtgtcgtgagaaggacattgtgaaactcttgttaatttggtttgcacttttcataacatggatagtctagatttatgttagcattttaaaaactgtttttgatatattcaagtatatatgaaaatctgtttggcattaagtgaattttaatgtttttgtttttatatccttttagctcttaagtgttgaacactgttgacagtgaagaacttttcttaatggttttcagtataactaataaggatgtgaagcttttttctctttagttctgagtatgctaaactgtgtgcttatatagactataaccagttgtgccttccttcgcatttaatgtaaatgaatgatttatatattttttagtattaagaggaaatgtttgaaagatgaaaattagtatcaaacagctctctagtagaatttcattatttttcaccagtgggcaatatgaaagcatatatcacgttttgttttactttcaattgtataagaattgccttagaacctcttttgaactgaaattcagtaaatgtccaagtaatgtttttataataaactaagccatatttagacaataaacattgataaaatgttctaaagtacattttcaaaagaatggaccttgaaaggctagcctccttagctgtttacagtatcttatcttttagatgcctcccagacaaaaatctgagatggaaaagctacatcaagttcatgctattccaggcccaagaatatctcctaggttagcatattcttatttcaaaaaattagccctggttttctcagttttccatagggaatcccgaccatctgatatatttactgtgtcagtataagtaagttggggttcccctggaactataattaacatttaaaaaatctaatgctttagaagaagctcacagagtggtgatgaacccaaacaacaaagaaaccatttttaacactaggtatcttcatcagtataggtaggtgttcacaatttttgatggatcaaaaacttgctgtaatacaaatagagagtggaggtactaaaggccttgcttgtggaaactgagagaggatacactgctttatgtattactaaagttaggggagaatgaaggaaatctgacagatgaaaaattctacaggaacctcatcatcgtggaactgaactgatgataacttggaacactccagtaaattctgttgtgtaatgtaatttggagcagtgataatacagacatattttctgttccatcagaaaatcagcaggcaccagtccaaaggtaccacacctgtacatgaagaaggaaagttctaatacaagaaaactgaaaagcaccaagctttaaattcaagattaattacaatccttaactataagtgatgataaaaactaacttgaaatgtgactaaataactgatccaaactgggcattaagtggcaggattatgagaaaggataaaaaaagagatttgagaaaacacatttcttgaattttcagaaaaaaatctagactattgctttgacacttagaaattctgaggtttttcaattggaattgagcatctctgtatgtggggatgtgggcccttatcaagggataaaaatccaaacactctaacatgcctccttgactgtaaagtaatgacactggttccaaaattcacaaataatagacactactgtccccccacccccaccccataggctaagaataattctgtaccagaataaaaggagctggtccagggaactgatatttactgaacatacaaagttagtgctagaaggggcctttgagaatgcttcccgccacctgtttccagctcaagacaggtgcacagcagaagctgggagttgcctatggctgcacagctcactgaaggtagaacaatgattggtgctcagtccaattctgtctcccccatgcctagctgttaagtaattactggttcaaaactacgtgttattagtaaaacaaacaaaacagataaagacagcatttaaaactgtgttgtcagataagagaacacatccaaaatgcatgattcttacaaactaaaggaagttaatgtgcaaaaatctcaaccaaaactactatttttagtatacttgtttacgtaaatgctgattggaaatatttaaatgactatagatctgattctttcttttcctttggaaactgggattaatgtatgctctagatccatttattagaaatgcaaaaatactacaattttttgatggatgaaaatactcctgtaacacaaacagagaactggaggaactgaagaataactcactcatatagctctgcctcattctgtgtgtgtgtgcatgtgtgtgttagcagaggtattttactcagaaaataggtttcaaagaacattaatgactttcttttcccttttatgtctgcttaatcagtgttaaactgctatgggaaaagttttatagaactatataacctgaatgttggtctctttgtacacatcttttctatgactgcaaatcttcactttatgtatcatttttactgtcatattatttttgttcaataaaaactttgtgataaaaggtgtttagaggtaactggattggcttact

SEQ ID NO: 31600 - DNA, 811 bp, Homo sapiens
actatacagtgtcaaagcagggtcgtcgttcggttgtacagcgtcggacagcagctgggagttgcctatggctgcacagctcactgaaggtagaacaatgattggtgctcagtccaattctgtctcccccatgcctagctgttaagtaattactggttcaaaactacgtgttattagtaaaacaaacaaaacagataaagacagcatttaaaactgtgttgtcagataagagaacacatccaaaatgcatgattcttacaaactaaaggaagttaatgtgcaaaaatctcaaccaaaactactatttttagtatacttgtttacgtaaatgctgattggaaatatttaaatgactatagatctgattctttcttttcctttggaaactgggattaatgtatgctctagatccatttattagaaatgcaaaaatactacaattttttgatggatgaaaatactcctgtaacacaaacagagaactggaggaactgaagaataactcactcatatagctctgcctcattctgtgtgtgtgtgcatgtgtgtgttagcagaggtattttactcagaaaataggtttcaaagaacattaatgactttcttttcccttttatgtctgcttaatcagtgttaaactgctatgggaaaagttttatagaactatataacctgaatgttggtctctttgtacacatcttttctatgactgcaaatcttcactttatgtatcatttttactgtcatattatttttgttcaataaaaactttgtgataaaaggtgtttagaggtaactggattggcttact

SEQ ID NO: 31601 - DNA, 781 bp, Homo sapiens
tattcgtgctcggtaccctcgtagctgggagttgcctatggctgcacagctcactgaaggtagaacaatgattggtgctcagtccaattctgtctcccccatgcctagctgttaagtaattactggttcaaaactacgtgttattagtaaaacaaacaaaacagataaagacagcatttaaaactgtgttgtcagataagagaacacatccaaaatgcatgattcttacaaactaaaggaagttaatgtgcaaaaatctcaaccaaaactactatttttagtatacttgtttacgtaaatgctgattggaaatatttaaatgactatagatctgattctttcttttcctttggaaactgggattaatgtatgctctagatccatttattagaaatgcaaaaatactacaattttttgatggatgaaaatactcctgtaacacaaacagagaactggaggaactgaagaataactcactcatatagctctgcctcattctgtgtgtgtgtgcatgtgtgtgttagcagaggtattttactcagaaaataggtttcaaagaacattaatgactttcttttcccttttatgtctgcttaatcagtgttaaactgctatgggaaaagttttatagaactatataacctgaatgttggtctctttgtacacatcttttctatgactgcaaatcttcactttatgtatcatttttactgtcatattatttttgttcaataaaaactttgtgataaaaggtgtttagaggtaactggattggcttact

SEQ ID NO: 31602 - DNA, 2169 bp, Homo sapiens
ggcgcgcggcgcggggcggaaaagcctgtttacacagactgcacaccgcctggggaataatgcagtaaaggaagtgagccggctcggcctgactgctccaacttcctgctctcacacacaccagaggggaaaaaaaaagaggagcgagagaaagaaaaaaagggggaaaaatcaggatctcattacaagagccacagaccgtctgcagacgcctgtcagcatggaaagtcgggggctttcgcccgggtcctcctagaaattccccccgaagaagactcccccacatctgggtatggagagtgcaatcacgctgtggcagttcctgttgcagttgctgctggatcagaaacatgagcatttgatctgctggacctcgaacgatggtgaattcaagctcctcaaagcagaagaagtggccaagctgtggggactccgaaaaaacaaaacaaatatgaactatgataagctgagcagagccctgcgatactattatgacaagaacatcatcaagaaggtgatcgggcagaagtttgtgtacaagtttgtctctttcccggagatcctgaagatggatcctcacgcggtggagatcagccgggagagccttctgctgcaggacagcgactgcaaggcgtctccggagggccgcgaggcccacaaacacggcctggccgccctcagaagcacgagccgcaacgaatacatccactcaggcctgtactcgtccttcaccattaattccctgcagaacccaccagacgccttcaaggccatcaagacggagaagctggaggagccgcccgaagacagcccccccgtggaagaagtcaggactgtgatcaggtttgtgaccaataaaaccgacaagcacgtcaccaggccggtggtgtccctgccttccacgtcagaggctgcggcggcgtccgccttcctggcctcgtccgtctcggccaagatctcctctttaatgttgccaaacgctgccagtatttcatccgcctcacccttctcatctcggtccccgtccctgtcccccaactcacccctcccttctgaacacagaagcctcttcctggaggccgcctgccatgactccgattccctggagcccttgaacctgtcatcgggctccaagaccaagtctccatctcttcccccaaaggccaaaaaacccaaaggcttggaaatctcagcgcccccgctggtgctctccggcaccgacatcggctccatcgccctcaacagcccagccctcccctcgggatccctcaccccagccttcttcaccgcacagacaccaaatggattgcttctgactccgagtccactgctctccagcatacatttctggagcagccttagtccagttgctccgctgagtcctgccaggctgcaagggccaagcacgctgttccagttccccacactgcttaatggccacatgccagtgccaatccccagtctggacagagctgcttctccagtactgctttcttcaaactctcagaaatcctgatgacgtctggccacaattaaggactcattaactgatgaaacaaatttgtccccacgggctagtttacctgtgtcgtgagaaggacattgtgaaactcttgttaatttggtttgcacttttcataacatggatagtctagatttatgttagcattttaaaaactgtttttgatatattcaagtatatatgaaaatctgtttggcattaagtgaattttaatgtttttgtttttatatccttttagctcttaagtgttgaacactgttgacagtgaagaacttttcttaatggttttcagtataactaataaggatgtgaagcttttttctctttagttctgagtatgctaaactgtgtgcttatatagactataaccagttgtgccttccttcgcatttaatgtaaatgaatgatttatatattttttagtattaagaggaaatgtttgaaagatgaaaattagtatcaaacagctctctagtagaatttcattatttttcaccagtgggcaatatgaaagcatatatcacgttttgttttactttcaattgtataagaattgccttagaacctcttttgaactgaaattcagtaaatgtccaagtaatgtttttataataaactaagccatatttagacaataaacattgata

SEQ ID NO: 31603 - DNA, 1848 bp, Homo sapiens
ggcgcgcggcgcggggcggaaaagcctgtttacacagactgcacaccgcctggggaataatgcagtaaaggaagtgagccggctcggcctgactgctccaacttcctgctctcacacacaccagaggggaaaaaaaaagaggagcgagagaaagaaaaaaagggggaaaaatcaggatctcattacaagagccacagaccgtctgcagacgcctgtcagcatggaaagtcgggggctttcgcccgggtcctcctagaaattccccccgaagaagactcccccacatctgggtatggagagtgcaatcacgctgtggcagttcctgttgcagttgctgctggatcagaaacatgagcatttgatctgctggacctcgaacgatggtgaattcaagctcctcaaagcagaagaagtggccaagctgtggggactccgaaaaaacaaaacaaatatgaactatgataagctgagcagagccctgcgatactattatgacaagaacatcatcaagaaggtgatcgggcagaagtttgtgtacaagtttgtctctttcccggagatcctgaagatggatcctcacgcggtggagatcagccgggagagccttctgctgcaggacagcgactgcaaggcgtctccggagggccgcgaggcccacaaacacggcctggccgccctcagaagcacgagccgcaacgaatacatccactcaggcctgtactcgtccttcaccattaattccctgcagaacccaccagacgccttcaaggccatcaagacggagaagctggaggagccgcccgaagacagcccccccgtggaagaagtcaggactgtgatcaggtttgtgaccaataaaaccgacaagcacgtcaccaggccggtggtgtccctgccttccacgtcagaggctgcggcggcgtccgccttcctggcctcgtccgtctcggccaagatctcctctttaatgttgccaaacgctgccagtatttcatccgcctcacccttctcatctcggtccccgtccctgtcccccaactcacccctcccttctgaacacagaagcctcttcctggaggccgcctgccatgactccgattccctggagcccttgaacctgtcatcgggctccaagaccaagtctccatctcttcccccaaaggccaaaaaacccaaaggcttggaaatctcagcgcccccgctggtgctctccggcaccgacatcggctccatcgccctcaacagcccagccctcccctcgggatccctcaccccagccttcttcaccgcacagacaccaaatggattgcttctgactccgagtccactgctctccagcatacatttctggagcagccttagtccagttgctccgctgagtcctgccaggctgcaagggccaagcacgctgttccaggtgagcgtttggaaatgaacttttgaacattaagcttctgagggatggttttttctctaaatcctgcagaggtaacggtgagttttgccatatgttgagttgaaatattaaatgtccagagggggttcatgttagtggggttgcacgcccttcagaggcagacattttcattgaggcagaaattgcagactcatgccagacacccatacgtggaacaattagttcttaaagtgttttgcatattttcatttgtctatgaaaacaggaaatttattaaggaaaaggcaaaactttaagaattattctttaggccagtgtgatggctcacacctgtaatcccagcactttgggaggttgagggtgggaggattgtttgagcccaggagtttgagaccagcctgggcaacacagcaagaccccatctatattta

SEQ ID NO: 31604 - DNA, 453 bp, Homo sapiens
gagtaagttacatgagatcatttaagtttcatttctattgttggccatttgttatatgaataaagatttgctaagtgaccctcaagcttgggtctttatttcatttttagattatataaggcttgacccacttaagaaatgtaaccgtctttttatttctcctattaattttttttttgtctttgtgactatcttgtttatacaaactgaacctgagacaaagccgctagtgactgctttttgtggttaaactggtttcgaacccaccaaagtctagaagagggaaagaaagaattgtaccagatttgatgtgttttgtgtaacgtaagccagattgtacctccttctctctctcccaggtctgtatacaacttaggaccaagaggtggactttggtgtcttagttcaagctctaaaaataccagggaagcagggaccacgacacatcccagg

SEQ ID NO: 31605 - DNA, 257 bp, Homo sapiens
  misc_feature (169)..(169): n is a, c, g, or t
gaatatagaatttaaggacaaaaggtatgcttgctttgcctgtttttacagtaaaaaactgtgttgattgtgttgactgtgtgtcaggtagtaataagtgctttgtgttcaatttttcttctgttttaatgacagcattaggaggaggtcccattactatcttgttttntacacttggaagataaagcttaaaagttagggtttgttgccaggtgtggtagctcatgcctgtaatcctagcactttgggaggatcgc

SEQ ID NO: 31606 - DNA, 369 bp, Homo sapiens
ttatgaagaaaagaggtttaattggctcacagttccacaggctgtgaggcctcaagaaacttaaaatcatggcggaagggctaaggggaagcaggcaacttcttcacgtggttgcaggagagaaagatcaaagggggaaatgatacacacttaaacacatcttgtaagaactcactcactatcacaagagcagcaagagggaaatctgcccccatgatccaattacctcctgccaggtccctcccccaacactgaggattacaattcaacatgagttttgagtggggacacagaaccaaaccatatcattctgcccctgtcccctcccaaatctcatgtccttctcacattttgaaaccgatcatgctc

SEQ ID NO: 31607 - DNA, 1044 bp, Homo sapiens
gttactgtttggatttacatagaaagacttttgccaaagcctgtgctgaacacataccaaaacaattatgcctagcatgtacacagtgataagaatgttttcttttggcatccactagaggagaaacttagagcagcaccactttctactgctacccttgggtccatgctgcggtagttatttacctgaattgtccttggaataactgcatttccttgtatatgaaatggacctaaagtaatggatttgcccattagtgaataatatcggaagcaatctcaattctaatgcaattcctgttcagttccatgcaatttctgcatagaaacacaactgaaagaaaaatgacaaccaatcgaccagtaaaactgcaataaatactttttaggtgagaaaacgtcaaaagagtgtggatttggaggtccttccattgtgctaattatagatctttattatctctctgaatacttgtcaatagtcattaagtttatacaattttctctttttaatgcatcaaaaaatcaccaaataggaagaagtaaatctgtataacgggacatctaaccattggttttaaaatacataacctacagtctaaaataaagaagaaatatatacatgtgaagcttttttttttgactgactatattataaaatatgctaaaattgtactgcaaatgaactctcctcacctcccaaataataacaaaacatacagtgacaacaaaattgtacaagtttatattaaggctctcaaatttaaactaagcataaaaactgagcaatttatcttgggattctaaaaaaaaaatgaatctaacaaaatccaaattgatgatacccgacatgttgtcatcatataacagtcaaagtttattctctgaagaaatatcaagttttaaaaataaatgggaacaataccaagcatcatctaaaggccagtttctagttttctcagcaccatgggtaacttttgtaagaaatgagataatcctgtaatcccagctactcggggggctgaggcaggagaatggcgtgaacccg

SEQ ID NO: 31608 - DNA, 750 bp, Homo sapiens
aaatttctattttacaaatttttcagggaatcatattcttaacttcactgagaaaaatgtgttactcttttggacaatttatcttatttctatcatataagatgtatttttttattgtccttaaaagaagctctagcatgaaattaaaggaaagggaaagaaatagatctggtgcacccgaacattaggagaaaatgaaaaatatacaaccaaccgttcgtgagtcatcaaaaagtcaaagtcagcctggccaacatggcaaaactccgtctctgcaaaaaatacaaaaatgagcccggtatgttggcatatgcctgtaatcccagctactcgagaggctgagacacgaaaattgcttgaacctgggaggcggaggttgcaatgagccgagatcgcgctactgcactccagcctgggcaacagagagagaccttgtctcaaaaaacaacaacaacaaaaagtcaaagtcataataagcaaattattggcttctttcttctagaccaaaagaaattaaagagatgaaacaatcaattgcaagggtcaaaactagattggatcttggtttgaatgaaaaaaagcataaaatattcttgcaataattgtaaaaatttgaatgtggactaagtcctagattatattaaaatatttttaattttttaagcttgacaaatgcactgattgttatactttaaataactaaaaatctgagaatccacagtgctacagacaataagtgataaaatggga

SEQ ID NO: 31609 - DNA, 493 bp, Homo sapiens
tccccacaagcattcaaaactcatacagcatgtgtgcttttctcctgctcatctgcctggtgttgatttagtttctaaagctggctgaagagcccactaacagctaaagacgggcaggaggtgacctctggctcccctgcagtgctttctaaactatgccaaaaggtagtagcctaaaacagccctaaatgtgtattattttctgctgtttctgagggtcaggaagtggggagaagcttacctgggtggtttcggcttagggtctcatgagatttcagctgagatgaaaaacagaaagtcatgattcatgagagtgaggctggctgactttctcatgagagaggacgtggaggggatggaggagattgctggggatggaggatttgtttccaaagcggcttgctcaccaggatactggcagggggcctcagttcctcaccacactgacctctccatacagctgcttgagtgtcctcatgacagggcgctggct

SEQ ID NO: 31610 - DNA, 407 bp, Homo sapiens
tactggtattactatatgcaatttgaaaatactggtataggagatacagtgcaattttttttttagtctgtgcttgcagtctactggagactgaaatgtaaaaagctatgcacaaggtaatatacatataacaactggcattcctttgggctagaactcccaaagaagaccagcttctaatattcttgaacactaaggactcatcaagagcagtgaattaaaaaagtaattttaccattttttttccaaccatggtgcaaaagagtatctaagacatacagcaggggttttaagagtggactataagaagatatatctccctctattggtaggtggattctagactcatactcaattataaaaaattataattatgtcttatgaaataaaatatgggaaatcttttt

SEQ ID NO: 31611 - DNA, 411 bp, Homo sapiens
tgtgcttaagatctgtttctctggtgatgagaagcctgaggctggcctttgtctactctcaggaagagtgctgtctttgctacctcacagcacttctctcctgtctttcagtgtttcatgccaagcacctgttgccccagcccttcatttcaaatctccatcatcatgtttcatcctttattggccctgacatttgtcttgacctacacaagagacatattcattctgagttctttttcttacacaagagttgctaagcattcttcaactaccctgtgaaaggtcttggtaatatttgagtgggttcaaccaggctagttcagggattgttgttaaacagaatgtttaacaaaagtactacaaacatttacattagaagatctattcagcatattgtgatatttgccgcca

SEQ ID NO: 31612 - DNA, 268 bp, Homo sapiens
ctggaaaatgctaccatacacccatgagagcatgacagtgaaaaagacaaacagggttttactactactctgaaaatggttttgaccatgtagtttccatgaaagtcttggggattcccaggggttccaggccacactttgagagctgctcttctgtctagtcccccaggtgtcttcttagatgtcttctctcccagtcattacacacatctcatatgttactaagtctttttttttttttgaagacggggtcctgctgtgttgccca

SEQ ID NO: 31613 - DNA, 921 bp, Homo sapiens
atggtgactgagtttcttcttctcggcttctcccacctggccgacctccagggcttgctcttctctgtctttctcactatctacctgctgaccgtggcaggcaatttcctcattgtggtgctggtctccactgatgctgccctccagtcccctatgtacttcttcctgcgcaccctctcggccttggagattggctatacgtctgtcacggtccccctgctacttcaccacctccttactggccggcgccacatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatcccgcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcgtggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagagaaccatccagaaaacggtgcctatggagatttga

SEQ ID NO: 31614 - DNA, 395 bp, Homo sapiens
gtagagacgaggtttcaccgtgttagctaggatggtctagatctcctgacctcgtgatccgcctgcctcggcctcccaaagtgctgggattacaggcgtaagccgccgcgcccggccttcttcactattttaaattgttagcattactttttacattcactttttacatatttcttacattacatttcattttacattcgctatgtatttcacttccgcattgtttccaacactggaggtataaacggtgtaaagacatttggagagttctaattcgttttatgcatttttggcaaatttgactccacgaaaatacattatcataatgttaactctgtgtgcaaacattatgcatacacataagaatgttgaaatttcctgtataaatgaagaga

SEQ ID NO: 31615 - DNA, 494 bp, Homo sapiens
agttttcatgttttcagaatgaagatgcattttttaaaaacgtactaggtacttacccgaggccatggtttgacctgcagatgacttcaacgtttggaactatggaatgcagaatgaaaactaaaagtatggctgaagacaaaaggcacgaggagatggttatctttctctctagcactactgaactattaccttaggaagaatatatttagagcatggaagtctattaacttttcctcattttaaatgttctttttaattacagagccacttagaaaatattctagcttttcatatcagtgttttcttctctgtcttatcccggtgtagataagccaatttcttttacatatctgagctgctcattaattaagaaaaactcagcattagttaccgttcatgagtcctcaaaaacacaaaattccacattccagcatgtgttacattaagtggaaaagatttgtctaatgctgtcctcatttttagtgcaggtg

SEQ ID NO: 31616 - DNA, 286 bp, Homo sapiens
ggcaatctgaattcctacttaaaaaatgccattgcactctagcctgggcaacagagtgagaccctgtctcaaaaaaaaaaaaaagcccttttctatcttaaacagccaattaaatgccttaccctccaaccagttctgcaactgccctgagtctgtgtcttagcaaagaggccattagccacccgactccctggcttatcactgggcccttcctcatcagacacagagatcaaattctgagggtgtacagcagctcttagcaggcttcaaagagctctgggactgc

SEQ ID NO: 31617 - DNA, 550 bp, Homo sapiens
gtacccacaattaaacctacctgctctggaccagtggtcaacccttcaccaactggctgtagtaagataacaacactcttagcacagccctttcctaggagactataaacgatgaggaataactgtcagtattcaatgagtgctccataaatagtttcattataatgagaacagtgtatatgtaatgggatagaagttgtttcacatttcttttgcaaaatggcatgctgggataaatgataatatgtgaggctttgggttttattttgatcttattggactcatgttggaaaaaaataaactcacttgttacatgagattccaacacagatattttaacctgctgtctttgtaacgtgtgacagtataatatgtggaaatgggagactcattaaatcaaggtaagccatggcctttcagcaagttatctaagcctcttaaggcttggtttcttcattcagagtgaggacattagtgccatagctagaagcataatacaaagtaagtgagcaaaaatatgtaaaaagtgaagataaaaggtaaaagttaa

SEQ ID NO: 31618 - DNA, 1191 bp, Homo sapiens
gaagttccttattgagggtaatgatgtttttaaagaacatagaacattctttatgttttaaaagaatcatgccttcattaagtaggctttattctaagtttggaactgagactgttatgcttttaaagtctccaacagagaggttaaggagttaacctggggcatgccagaactgggatggaatggccttgaaagattttagtgcattgcacttgacttagataggatctttactgacccttgcttacttaggagtggcagagttaattggtggttcagatattaaggggctactgtcactctgatatgtagcttttctatcatctctgtaacttagcttcaagtaactagaagagtaatctaaaaaaaataattagcctttaatcagattgcctgcagtgtttcttggtcactttaaagccgtgactttgcatgattgctaggtaagttcacttaagaaataggaaattcaaattatttatgtttcaagtatttttgaacaggtggtaaaatgaaattgatttttatcatctttgaatgaaagtaacagcagatattcaatgagtgacttattttgtggacatttttgtcctttggatatgatgtatagagtcacaatatattttcagccttttttgagaaataagtgatttagacatcttacacagttactgagcacctggtacagtgaagatctctcaagaatgatttgtgtgatgtagttcggtggatcatccagcagagggcagtagagccagagccatagtaaaagttatagtaaagttgctcttagcaacttgagtcttacttagatttaattttgcatagaaccaaaagttcagtttagtagccattttctttaaagtcaggctgtagtggttccgaaatgaaaattaggccctgattttatgtaagatgatgtccaatctttaattgacaccttaaaaatattaaaagattatgataggatcaggaaggagtttttgaaaatgcaatttgtagtttttaacaagtgatgtagaataaataaaaagaagtactttttaaaaagtaagtataaaattattttccagttaactatgggatataaatgattgctttaatacaggtcttcctaacctgtacagcatttcctaacctgctctgtgaaaaacaaagaaataaaacttagtgctctctttaaaaaaaatt

SEQ ID NO: 31619 - DNA, 686 bp, Homo sapiens
ctcacagttctggaggcttgaagtccaagatcaaggtgttagcaagtttcatttcttctgaggcctctcgccttctcttgcagatggttgccttcttgctgtgtcctcgtgtggtcttttcttctgtgtgcgcattccttgtgtctctttgtgtgtccagatttcctctcctttataaggacacatcagatttgaagtacttaatttccatatatattgagtgtattagtttcctattgttcctataacaaattaccacaaatttagtgacttaaaacaatgcaaacgtattatcttacagttctggaggccagaatttctaaaatcgaaatgttggcagggctgtattccttctggaggctctaaagaagaatctatttcctttccttttccaatgtctaatgcctgcccagattccttggcttatggtcccttcctcaatctttaaagccagcagcatagcatcttcaaatctctttctctgacctctgcttctgtcatcacatgtcctctctgactctggtcctcgtatctccttcttataagaatccttgtagctaagtgtggtggcatgtgcctgtagtcctgacagctcaggaggctgaggcgggaggattgcttgagcccaggaatttaaggctacagtgagctctgattgcaccactgttctccagcctgggtgaccg

SEQ ID NO: 31620 - DNA, 380 bp, Homo sapiens
tgtggtgtttgtgttctgtgccgatgtccctcccccagccctgttattgtgagtggaagaaggggaaagggttcgcccgctactgtgagcccctcctctcacgctgggtgtccttggagaagcctgcacttcttcattgtacgccagggctgggtccctccctggagtggttctgtgctgctgggatggggccaacccctcagatgttttctgagtgtcacacacaggtgtgtgcattcatggcctttgcgtgtcttcctgttgtggaggcaaaaatgtgaagaaccctagatgattttgggaccagggctccatcacctgctgttcattgcacaccggagcatccaggcatgggtggagagctcagacttccaggcacg

SEQ ID NO: 31621 - DNA, 2291 bp, Homo sapiens
gtgaccccaacagagtgtcccgggactcaggcctctgatcaagttacccccagaggatcagagaggggttgacgaaggagaagcattcagagggcactggcttctggacagcaatgagtgcccgggccacgcggccccgaagccggcgagggaggcatgctccacccggtgaactggatcccgtggctgagagttcagaggaggtcgaggcagccagtgggagctccaagcccagctttgccccacctccggtgagctccgggctggagcagctgggccccatggaggaggtcagtggccaaggcctaggaagcaggactgacaagaagatggatgggggctctggcagggaactggcctcagcccccgaagtgccccacaaacctgcagtggaagcccaccaagccccagaagcagccctacagtacaaggagactgtgccccctgggaatggggcccccgatgtgtttcagaccctccagcacactctgagctccctggaggcagcggctgcagcctggcgccaccagccccccagccattctgggccgatggagttcgaaggcacaagcgaagggggagcaggttcccttgggaagcaggaaggggcagggagctgccagcgagaggcagctcgcctggccgagaggaatgcctggctccggctggccctgagtagccgagaggatgagctggtccgcacgcaggcctccctggaggccatccgagctgagaaggagacgctgcagaaagaggttcaagagctgcaggattccctcttgaggctggagccctgcccacatctttcccacaaccaagcaggtggctcaggcagtggttctagcagctctgaggcagacagggaaccctgggagactcaggactccttctccctggctcaccccctgcttcggcgcctccgcagccattccagcacccagatccttgggtctcttcccaaccagcccctcagtcctgagatgcacatcatggaagcccagatggagcaactccgggggagcattgagaagctcaaatgctttaatcgtctgctatcagctgtgctacagggatacaagggccgctgtgaaggcctcagcatgcagctaggccagcgggaggctgaggccacagcattgcatctggccttgcagtacagtgaacactgtgaagaggcatacagggttctgcttgctctgcgggaggccgactcaggagcaggagacgaagcccccatgagtgacctgcaagcagctgaaaaggaagcatggaggctgctggcacaagaagaagctgccatggatgcaggaacacagcagaatccacagccaagccctgaaggcagcagtgtggataagcccaccccacaggaagtggctttccagctccgaagctatgtccagcgtctccaggagcgccgttctctagtgaagattctctcagagcctggccccaccttggcacccatgcccattgtgccccgtgcagaagccatggtgcaggccattctggggacccaggctggcccagctcttccccgactggagaagacacaaattcagcaggacctggtggccgcaagggaggccctggcggacctgatgcttcggctgcagctggtgcggcgtgagaagcggggcctagagctgcgggaggctgccctccgagccctgggtccagctcacgtgctcctgctggagcagctgcggtgggaacgggcagagctccaggctggtggggcaaacagcagtggcggacatagcagcggaggtggcagcagcggggacgaggaagagtggtatcagggccttcctgctgtccctggtggcaccagtggcattgatggtggccaggtgggcagagcctgggacccagagaagttagcccaggaactggcagcatcgctcaccaggacactggacctgcaggagcagctgcagtctctgcgcagggagctggaacaggtggctcagaaggggcgagccagacggtctcagagtgccgagctgaacagggatttatgcaaagcccacagcgccctggtcctggccttccgaggagcccaccggaagcaggaagagcaacgccggaagttggagcagcagatggcactcatggaggctcagcaggccgaggaggtggcggtgctcgaagccactgcaagggccctggggaagcccaggcctcccctcccgcctccccagcttggggacacctttctgtaggccccttacccagccatgtctggacatgccagacagctgtggcatgtcataaactgtcctggagtg

SEQ ID NO: 31622 - DNA, 2731 bp, Homo sapiens
gtgaccccaacagagtgtcccgggactcaggcctctgatcaagttacccccagaggatcagagaggggttgacgaaggagaagcattcagagggcactggcttctggacagcaatgagtgcccgggccacgcggccccgaagccggcgagggaggcatgctccacccggtgaactggatcccgtggctgagagttcagaggaggtcgaggcagccagtgggagctccaagcccagctttgccccacctccggtgagctccgggctggagcagctgggccccatggaggaggtcagtggccaaggcctaggaagcaggactgacaagaagatggatgggggctctggcagggaactggcctcagcccccgaagtgccccacaaacctgcagtggaagcccaccaagccccagaagcagccctacagtacaaggagactgtgccccctgggaatggggcccccgatgtgtttcagaccctccagcacactctgagctccctggaggcagcggctgcagcctggcgccaccagccccccagccattctgggccgatggagttcgaaggcacaagcgaagggggagcaggttcccttgggaagcaggaaggggcagggagctgccagcgagaggcagctcgcctggccgagaggaatgcctggctccggctggccctgagtagccgagaggatgagctggtccgcacgcaggcctccctggaggccatccgagctgagaaggagacgctgcagaaagaggttcaagagctgcaggattccctcttgaggctggagccctgcccacatctttcccacaaccaagcaggtggctcaggcagtggttctagcagctctgaggcagacagggaaccctgggagactcaggactccttctccctggctcaccccctgcttcggcgcctccgcagccattccagcacccagatccttgggtctcttcccaaccagcccctcagtcctgagatgcacatcatggaagcccagatggagcaactccgggggagcattgagaagctcaaatgctttaatcgtctgctatcagctgtgctacagggatacaagggccgctgtgaaggcctcagcatgcagctaggccagcgggaggctgaggccacagcattgcatctggccttgcagtacagagtcttgctctgtcacccaggctggagtgcagtggtgccatcttggctcactgcaacctccgcctccccagttcaagtgattctcctgcctcagcctcctgagtagctggaactacaggtgcgtaccaccacaccttgctaatctttgtctttttagtagagacggggtttcaccatgttggtcaggctggtctcgaactcctgacctcaggtaatcctcccaaagtgctgggactacaggtgagggccattgcacccagccgagctgagtgtcctgaagcactcagaaccagtgtcccacagtgaacactgtgaagaggcatacagggttctgcttgctctgcgggaggccgactcaggagcaggagacgaagcccccatgagtgacctgcaagcagctgaaaaggaagcatggaggctgctggcacaagaagaagctgccatggatgcaggaacacagcagaatccacagccaagccctgaaggcagcagtgtggataagcccaccccacaggaagtggctttccagctccgaagctatgtccagcgtctccaggagcgccgttctctagtgaagattctctcagagcctggccccaccttggcacccatgcccattgtgccccgtgcagaagccatggtgcaggccattctggggacccaggctggcccagctcttccccgactggagaagacacaaattcagcaggacctggtggccgcaagggaggccctggcggacctgatgcttcggctgcagctggtgcggcgtgagaagcggggcctagagctgcgggaggctgccctccgagccctgggtccagctcacgtgctcctgctggagcagctgcggtgggaacgggcagagctccaggctggtggggcaaacagcagtggcggacatagcagcggaggtggcagcagcggggacgaggaagagtggtatcagggccttcctgctgtccctggtggcaccagtggcattgatggtggccaggtgggcagagcctgggacccagagaagttagcccaggaactggcagcatcgctcaccaggacactggacctgcaggagcagctgcagtctctgcgcagggagctggaacaggtggctcagaaggggcgagccagacggtctcagagtgccgagctgaacagggatttatgcaaagcccacagcgccctggtcctggccttccgaggagcccaccggaagcaggaagagcaacgccggaagttggagcagcagatggcactcatggaggctcagcaggccgaggaggtggcggtgctcgaagccactgcaagggccctggggaagcccaggcctcccctcccgcctccccagcttggggacacctttctgtaggccccttacccagccatgtctggacatgccagacagctgtggcatgtcataaactgtcctggagtgacatcatgtcatgttgcatgatttggcatgttggggcacatttggcgtgagggaagctggtgcacatgggtgtccagggcctgatggggtgtggccaggcaatgaagaaagactcaggtgtctttggcctggcacca

SEQ ID NO: 31623 - DNA, 3604 bp, Homo sapiens
  misc_feature (510)..(510): n is a, c, g, or t
  misc_feature (546)..(546): n is a, c, g, or t
  misc_feature (568)..(568): n is a, c, g, or t
  misc_feature (586)..(586): n is a, c, g, or t
  misc_feature (594)..(595): n is a, c, g, or t
  misc_feature (609)..(609): n is a, c, g, or t
  misc_feature (613)..(613): n is a, c, g, or t
  misc_feature (627)..(627): n is a, c, g, or t
  misc_feature (631)..(631): n is a, c, g, or t
  misc_feature (657)..(657): n is a, c, g, or t
  misc_feature (1004)..(1004): n is a, c, g, or t
  misc_feature (1071)..(1071): n is a, c, g, or t
  misc_feature (1102)..(1102): n is a, c, g, or t
  misc_feature (1106)..(1106): n is a, c, g, or t
  misc_feature (1119)..(1119): n is a, c, g, or t
  misc_feature (1147)..(1147): n is a, c, g, or t
  misc_feature (1187)..(1187): n is a, c, g, or t
gtgaccccaacagagtgtcccgggactcaggcctctgatcaagttacccccagaggatcagagaggggttgacgaaggagaagcattcagagggcactggcttctggacagcaatgagtgcccgggccacgcggccccgaagccggcgagggaggcatgctccacccggtgaactggatcccgtggctgagagttcagaggaggtcgaggcagccagtgggagctccaagcccagctttgccccacctccggtgagctccgggctggagcagctgggccccatggaggaggtcagtggccaaggcctaggaagcaggtaagacccgcttggtctgtgcccttcactccagtccagacgcatctttgccatccacagatctgctgatgtgcctgctctgctcacacacctaccatagctccctattgccttcagcctgactttcttttttttttgagtcttgctgtgtcacccaggctgtagtgcagtgcagtggcacaatctcggctcanagcaacccctgcctcccggttcaagcgggagcctcngcttcctgagtagttgggattncaggtgtgcgccaccacntccggctnngttttgcatttttngtgngacaggccacattngccnggctggtcttgaactcctgcccttangtgatcccccaactttggcctccaaaagtgctgggattacaagtgtaagccgccgccccagaagaccctatttccagaaacttctgtctctcaccttcaggcctttcccagtgcccgtcacagtccaacttcactctgtttctcagctccaggtctcccctccaacttcttcaccacctctatctagcctcttccttgaattcacagcctcccagtctcaccctgggatgccagtcccagaacacgcagctcttgccaactccctgtccgctcacacctccccaagaccatgaagtttaagccctcagaattccctgcccagggccgagcatggtggctcatgcctntaatcccagcactttgggaggccgagttgggcggatcacctgaggtcaggagtttgacaccagcctngccaacatggtgaaaccctgtctctactaanaatncaaaaattagccnggcgtggtggtgggagcctgtaatcccngctacttgggggaccgaggcaggagaatcacttgaacccnggaggtggaggttgcagtgagccgagatcgcgccactgcactccaggctgggcaacagagtgagactccgtctcaaaaaataaaaaagaattccttgcccagcatggagtgactcaagtgcctgagttggtgtccacaggactgacaagaagatggatgggggctctggcagggaactggcctcagcccccgaagtgccccacaaacctgcagtggaagcccaccaagccccagaagcagccctacagtacaaggagactgtgccccctgggaatggggcccccgatgtgtttcagaccctccagcacactctgagctccctggaggcagcggctgcagcctggcgccaccagccccccagccattctgggccgatggagttcgaaggcacaagcgaagggggagcaggttcccttgggaagcaggaaggggcagggagctgccagcgagaggcagctcgcctggccgagaggaatgcctggctccggctggccctgagtagccgagaggatgagctggtccgcacgcaggcctccctggaggccatccgagctgagaaggagacgctgcagaaagaggttcaagagctgcaggattccctcttgaggctggagccctgcccacatctttcccacaaccaagcaggtggctcaggcagtggttctagcagctctgaggcagacagggaaccctgggagactcaggactccttctccctggctcaccccctgcttcggcgcctccgcagccattccagcacccagatccttgggtctcttcccaaccagcccctcagtcctgagatgcacatcatggaagcccagatggagcaactccgggggagcattgagaagctcaaatgctttaatcgtctgctatcagctgtgctacagggatacaagggccgctgtgaaggcctcagcatgcagctaggccagcgggaggctgaggccacagcattgcatctggccttgcagtacagagtcttgctctgtcacccaggctggagtgcagtggtgccatcttggctcactgcaacctccgcctccccagttcaagtgattctcctgcctcagcctcctgagtagctggaactacaggtgcgtaccaccacaccttgctaatctttgtctttttagtagagacggggtttcaccatgttggtcaggctggtctcgaactcctgacctcaggtaatcctcccaaagtgctgggactacaggtgagggccattgcacccagccgagctgagtgtcctgaagcactcagaaccagtgtcccacagtgaacactgtgaagaggcatacagggttctgcttgctctgcgggaggccgactcaggagcaggagacgaagcccccatgagtgacctgcaagcagctgaaaaggaagcatggaggctgctggcacaagaagaagctgccatggatgcaggaacacagcagaatccacagccaagccctgaaggcagcagtgtggataagcccaccccacaggaagtggctttccagctccgaagctatgtccagcgtctccaggagcgccgttctctagtgaagattctctcagagcctggccccaccttggcacccatgcccattgtgccccgtgcagaagccatggtgcaggccattctggggacccaggctggcccagctcttccccgactggagaagacacaaattcagcaggacctggtggccgcaagggaggccctggcggacctgatgcttcggctgcagctggtgcggcgtgagaagcggggcctagagctgcgggaggctgccctccgagccctgggtccagctcacgtgctcctgctggagcagctgcggtgggaacgggcagagctccaggctggtggggcaaacagcagtggcggacatagcagcggaggtggcagcagcggggacgaggaagagtggtatcagggccttcctgctgtccctggtggcaccagtggcattgatggtggccaggtgggcagagcctgggacccagagaagttagcccaggaactggcagcatcgctcaccaggacactggacctgcaggagcagctgcagtctctgcgcagggagctggaacaggtggctcagaaggggcgagccagacggtctcagagtgccgagctgaacagggatttatgcaaagcccacagcgccctggtcctggccttccgaggagcccaccggaagcaggaagagcaacgccggaagttggagcagcagatggcactcatggaggctcagcaggccgaggaggtggcggtgctcgaagccactgcaagggccctggggaagcccaggcctcccctcccgcctccccagcttggggacacctttctgtaggccccttacccagccatgtctggacatgccagacagctgtggcatgtcataaactgtcctggagtg

SEQ ID NO: 31624 - DNA, 350 bp, Homo sapiens
  misc_feature (87)..(88): n is a, c, g, or t
  misc_feature (92)..(92): n is a, c, g, or t
  misc_feature (102)..(102): n is a, c, g, or t
gttgaggggttacaggcaccattgacatcatgggcagggaaagaagggaagccgtcagccaggggaaagagtgaggcaaaagagagnncagnccagtgaatngaaagacgatatggttccagggaggcagcgacaggtccacagatgaggatgggccctggctgtctcaaagaacgttatctgttttcttatttccatcctttttaagactagactgctcatgcttctgcgatagatttctccttccttctaaggtgctttcttgacttaatacagtttgagccggttttccttatttgaaaccaaaagtacttacctaggcaaggattctgtagtacactgatatcagg

SEQ ID NO: 31625 - DNA, 327 bp, Homo sapiens
gaacaagccaggtattcaagtcacatcctaggagggtcgaaaagtgcaattcctcctcagtggacaaatctcatccacctgcgacgtgtgtgacagtattcagggtgaggaaaacatttgacaaaggaagaaaaaaaatctaatcccattacctttgatgagtgctcagaggaaactcctataaaaactgaagattaaaatgttgcatagtgatggcatatacccatgccctcacacagacctcatttcctctttcatattacccgataaatgcactacttttctcctaaagtgtatttttttaataaataaaatcagtaagatcct

SEQ ID NO: 31626 - DNA, 516 bp, Homo sapiens
tgaaaagtcagagttagattcttagtgcaattctattcatgtacatttaaaacccagcgctgtattttacatgcatagccaggcccgaatgccactggtgagtctggggggtgagtgtgtgtcgggggcatgacctgattgttctaaaatagacacccgcccgcctcactcaccggagggcacctgagtctggctgctaccaacacagaaaggaaaggtttcctggaggttaaagaaatgatttatcaggtcatttcagcaccttggagcctttgaaagacccagtatgtcaggagatgatacaggcagataagttatgatctaatgagggaagaaaagacaggcaccacctagaaaccccggggcaattcaggagggaagtccgaagaccgcaagggtgtacgaacaggaagaggaaaaaccccgaaggtaaccttttctagcatcacagttcagctcaaaactaaccagggaacggttaacccaacgcactttactgaagaatctaagctggaa

SEQ ID NO: 31627 - DNA, 375 bp, Homo sapiens
ttttttttgagacagtctcactctgttgcccaggctggagcgcagtggcacaatctcggctcactgcaagctccacttcccgggttcacaccattctcctgcctcagcctcccgagtagctgggactacaggcacccgccaccacacctagctaattttttgcatttttagtagagacggggtttcactgtgttagccaggatggtctcgatctcctgacctcgtgatccacccgcctcggcctcccaaagtgcgtgagccactgcgcccggccgagaatgtcattaatcttgagagatgcatgctaaagtatttaggggtgaaatgtcatgacatctacaacttattttcaggtttgggaaaaagtgtgtgtgt

SEQ ID NO: 31628 - DNA, 1162 bp, Homo sapiens
atggtcacatgacacgttttctgagggggggtggaatttacctttaaaaagcagtgacccactacacatgctagaacaaagtgtccaccatagggcattaccgtgatgatgcagttccgtggttttaggacagtgtctgcttaacagggctctccccttctcaggggcttgttggcttgctctgatttgatagcagaactggaattgagaatctttaccccttaaaccattaaccgtaacatcaatttttgttttgccttggttttgttttaaaataaatttatcctgcaaaggaaaaaaatttcattcagtggggattatgaaacaaaactgtgatctcttaaaaagcaggaataatttgcatcaaggggaagacacttagctatagaataacaaataattggagagacccaaatacagctgcatatgtattctgattctttatagacaggactaagacccacacaggattgaaagtcatgtaaactttacactgtgctctattgtaaaatattaccttctgcatgtattacatcctaaaaattaatagagaaattaaagaaagcaatagaaaaaatgtttagagagcaagggtttttgtaatctgaagggaggatgagaaaaaacacttatcccattcatggatgatgatgagggggaattatgttttaccacagctttatcttgagaaatgatgataagcataggttggaattgtagacaatttagatggctaaatgttagacgattttactatcttattgagcaaatatttgctgaggatttactaagttgctaggtacagagttaaatgagaaacattcctgaagacttaaggaaccaacagcccattagtaaaacaagataagcagataatgacagttgaaagtaggctctactctgattagtgtgtggaggaatgaggttattattaatgtccagaggaaaaatccctttctaagttagcacgaatttgattgttcaaccaaatgtgaaataagcatgctcacagtggaagagtgagcagcacactttgtctgcataaatgactgggattaaactgctggggcgaggagtatagaaaactgttattgtgtggacatgttagggtcttaaaaggtaagtagaagtttttcagctagagaagggtatttcatgcaaa

SEQ ID NO: 31629 - DNA, 2299 bp, Homo sapiens
  misc_feature (405)..(405): n is a, c, g, or t
  misc_feature (430)..(430): n is a, c, g, or t
cagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgnagaaactggcagctacttggtatcnaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaagttagagctggcaccagaactgagacctccagaaatctattccagtattttttccactacacaactgccttcctgacaggttctgagataagtgttatgtttgtagatagagtgaaatatatttatatatatataaatatatacagatacatatctgtgtattatctcaaggaatgtacaaactttagtttttgattataaggacttcactgcaagttttagttaagaggtttgtatataaatctgttatagaacaggctgaaatttcttgttcataagattatgaaaccacatgagaagtgataaaatgtttgttaaagctagatagaggttaagaatcaagatataatggataattttcatagctgcctatcagaatttcccaaatatttagcatcttccttgataatatgtattttcttcttgaatttcactggcctaatgagataatactcttatctttggctctacctaaaagttggttaaaaatgcaattggcattaacaaggaaaaatactgaattagtaattttaaaagtctcacaaagaaaatcccaggcctagatggctgcattgttgaattctgccaaacattaaaattagcactaattttttgcacactgtttctaaaagtaggagaggaaagaacacttcccaacttactctaggtcagtattaccctgatactagactagacatcacaagaaaactataagccaatattccttattaatacaaacacaaaaatcattaacaaaaatattagcaaactgaatccagcaacctataaaaaggattctatatcatgaccaagtggaatttatcccaggaattcaaggttggttcaacatctaaaaatcaaataagctaatatacagtcagttctcattattcacagtaattatgttctacagaatattctcccataaacactgaattaaatatggaacaactgctttt

SEQ ID NO: 31630 - DNA, 2797 bp, Homo sapiens
  misc_feature (405)..(405): n is a, c, g, or t
  misc_feature (430)..(430): n is a, c, g, or t
cagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgnagaaactggcagctacttggtatcnaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaagttagagctggcaccagaactgagacctccagaaatctattccagtattttttccactacacaactgccttcctgacaggttctgagataagtgttatgtttgtagatagagtgaaatatatttatatatatataaatatatacagatacatatctgtgtattatctcaaggaatgtacaaactttagtttttgattataaggacttcactgcaagttttagttaagaggtttgtatataaatctgttatagaacaggctgaaatttcttgttcataagattatgaaaccacatgagaagtgataaaatgtttgttaaagctagatagaggttaagaatcaagatataatggataattttcatagctgcctatcagaatttcccaaatatttagcatcttccttgataatatgtattttcttcttgaatttcactggcctaatgagataatactcttatctttggctctacctaaaagttggttaaaaatgcaattggcattaacaaggaaaaatactgaattagtaattttaaaagtctcacaaagaaaatcccaggcctagatggctgcattgttgaattctgccaaacattaaaattagcactaattttttgcacactgtttctaaaagtaggagaggaaagaacacttcccaacttactctaggtcagtattaccctgatactagactagacatcacaagaaaactataagccaatattccttattaatacaaacacaaaaatcattaacaaaaatattagcaaactgaatccagcaacctataaaaaggattctatatcatgaccaagtggaatttatcccaggaattcaaggttggttcaacatctaaaaatcaaataagctaatatacagtcagttctcattattcacagtaattatgttctacagaatattctcccataaacactgaattaaatatggaacaactgcttttaggagaaagtgtatttgtgtatatgtgtgtatacatatgtttatctcacacacattatgagcttgaattcttaattcatcctagcaaattctaccttattttacagaagtgaaagtgaggtatcagaagtgttaagtgacatgcctgaggcacccccctaacaggtgtcagagctgaaattcaaaccccatccagctggccccggagccagagcttcttgtactacacagaattgcccctgccatttccaccctccagtcatttctctatgagactgaagcaggaaggcagagcatcatcttgttcagcctcagctgggaacatgtgtactgggtgactcaaatttttcacccatttacacatatccacaaatgactgcaaaagtgccacggatatcaatttgagggttataaattttagcaagttggtaaattcacaaatacataaccttgaataatgaggatcaactgtaccatatttaataaagcacaaaaccca

SEQ ID NO: 31631 - DNA, 3223 bp, Homo sapiens
  misc_feature (405)..(405): n is a, c, g, or t
  misc_feature (430)..(430): n is a, c, g, or t
cagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgnagaaactggcagctacttggtatcnaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaagttagagctggcaccagaactgagacctccagaaatctattccagtattttttccactacacaactgccttcctgacaggttctgagataagtgttatgtttgtagatagagtgaaatatatttatatatatataaatatatacagatacatatctgtgtattatctcaaggaatgtacaaactttagtttttgattataaggacttcactgcaagttttagttaagaggtttgtatataaatctgttatagaacaggctgaaatttcttgttcataagattatgaaaccacatgagaagtgataaaatgtttgttaaagctagatagaggttaagaatcaagatataatggataattttcatagctgcctatcagaatttcccaaatatttagcatcttccttgataatatgtattttcttcttgaatttcactggcctaatgagataatactcttatctttggctctacctaaaagttggttaaaaatgcaattggcattaacaaggaaaaatactgaattagtaattttaaaagtctcacaaagaaaatcccaggcctagatggctgcattgttgaattctgccaaacattaaaattagcactaattttttgcacactgtttctaaaagtaggagaggaaagaacacttcccaacttactctaggtcagtattaccctgatactagactagacatcacaagaaaactataagccaatattccttattaatacaaacacaaaaatcattaacaaaaatattagcaaactgaatccagcaacctataaaaaggattctatatcatgaccaagtggaatttatcccaggaattcaaggttggttcaacatctaaaaatcaaataagctaatatacagtcagttctcattattcacagtaattatgttctacagaatattctcccataaacactgaattaaatatggaacaactgcttttaggagaaagtgtatttgtgtatatgtgtgtatacatatgtttatctcacacacattatgagcttgaattcttaattcatcctagcaaattctaccttattttacagaagtgaaagtgaggtatcagaagtgttaagtgacatgcctgaggcacccccctaacaggtgtcagagctgaaattcaaaccccatccagctggccccggagccagagcttcttgtactacacagaattgcccctgccatttccaccctccagtcatttctctatgagactgaagcaggaaggcagagcatcatcttgttcagcctcagctgggaacatgtgtactgggtgactcaaatttttcacccatttacacatatccacaaatgactgcaaaagtgccacggatatcaatttgagggttataaattttagcaagttggtaaattcacaaatacataaccttgaataatgaggatcaactgtaccatatttaataaagcacaaaacccacacagattgtcttattacagcatttgataaaatccaaaactctttcataaaaacactcaacaaacttaggaataaaaggaatcttcctagatatgataaatataacatctatgaaaagcccacacctaacattatacttcatggtgatagactgaaggctgaatgttttccccttaagattgggaagaaggacaaggatgttcactcggcactacttctattcagcattgtacttgaagttctagccacagcagttaggttaggaattcaaggtttgttcaacatctaaaaatcaaataagctaataaagaaaagaggtttatactgcaaaagaagtgaaactatatgtattcacagttgatacatagttgtatatagaaaatgctaaagaatccataaaaagtaataaatgagttcaacaggttg

SEQ ID NO: 31632 - DNA, 3279 bp, Homo sapiens
  misc_feature (405)..(405): n is a, c, g, or t
  misc_feature (430)..(430): n is a, c, g, or t
cagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgnagaaactggcagctacttggtatcnaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaagttagagctggcaccagaactgagacctccagaaatctattccagtattttttccactacacaactgccttcctgacaggttctgagataagtgttatgtttgtagatagagtgaaatatatttatatatatataaatatatacagatacatatctgtgtattatctcaaggaatgtacaaactttagtttttgattataaggacttcactgcaagttttagttaagaggtttgtatataaatctgttatagaacaggctgaaatttcttgttcataagattatgaaaccacatgagaagtgataaaatgtttgttaaagctagatagaggttaagaatcaagatataatggataattttcatagctgcctatcagaatttcccaaatatttagcatcttccttgataatatgtattttcttcttgaatttcactggcctaatgagataatactcttatctttggctctacctaaaagttggttaaaaatgcaattggcattaacaaggaaaaatactgaattagtaattttaaaagtctcacaaagaaaatcccaggcctagatggctgcattgttgaattctgccaaacattaaaattagcactaattttttgcacactgtttctaaaagtaggagaggaaagaacacttcccaacttactctaggtcagtattaccctgatactagactagacatcacaagaaaactataagccaatattccttattaatacaaacacaaaaatcattaacaaaaatattagcaaactgaatccagcaacctataaaaaggattctatatcatgaccaagtggaatttatcccaggaattcaaggttggttcaacatctaaaaatcaaataagctaatatacagtcagttctcattattcacagtaattatgttctacagaatattctcccataaacactgaattaaatatggaacaactgcttttaggagaaagtgtatttgtgtatatgtgtgtatacatatgtttatctcacacacattatgagcttgaattcttaattcatcctagcaaattctaccttattttacagaagtgaaagtgaggtatcagaagtgttaagtgacatgcctgaggcacccccctaacaggtgtcagagctgaaattcaaaccccatccagctggccccggagccagagcttcttgtactacacagaattgcccctgccatttccaccctccagtcatttctctatgagactgaagcaggaaggcagagcatcatcttgttcagcctcagctgggaacatgtgtactgggtgactcaaatttttcacccatttacacatatccacaaatgactgcaaaagtgccacggatatcaatttgagggttataaattttagcaagttggtaaattcacaaatacataaccttgaataatgaggatcaactgtaccatatttaataaagcacaaaacccacacagattgtcttattacagcatttgataaaatccaaaactctttcataaaaacactcaacaaacttaggaataaaaggaatcttcctagatatgataaatataacatctatgaaaagcccacacctaacattatacttcatggtgatagactgaaggctgaatgttttccccttaagattgggaagaaggacaaggatgttcactcggcactacttctattcagcattgtacttgaagttctagccacagcagttaggttaggaattcaaggtttgttcaacatctaaaaatcaaataagctaataaagaaaagaggtttatactgcaaaaaaaaaaaaaaacacacaaaactacaaaacacaacaacaccacacacacaacaaaaaaagggggggggggccccaaaaaattaccccgagggggcccaattccgccccccctttttgcgcaaaggggggccacaaaagaggcggcttaaac

SEQ ID NO: 31633 - DNA, 366 bp, Homo sapiens
ctgcgcaccgccggctgattacaggttaccgctccctcggctgtcaccctgtgactaccagaataaggcaacgacggtgggtgcacttcgcaaatatgctcccccgaagacctcttttgaaactataaagtggattagtaatgactacaaccagggatttgcaaatgcagttaaaactgtgtaatggatttctttaaagagtagtttaacagtaagaattctacccgattactttatattatagtatattacaaacttcaaaattagaatagatttgaagctattgaatacaatataaattcatgagtctatactgctgtaaataaatgaatgaataaatagaggggttaagccactctttcatat

SEQ ID NO: 31634 - DNA, 282 bp, Homo sapiens
ttttttaagtagagatggggtcttgccatattgctaggattacagttgtaagccactgcacccggccagcaacctgatcgtatagcagaggaaattgaggggcagagaggttaaggaacctgccaaatgtcacacagctggagaagcagagaagccagttgcccgagctcctcactgctctgtcagcctgattctcctcctcggggaggtcctcccttttcttccaagttctatcagggtcctcttgttccccctgactgtcttctgtgcctcctcctctgg

SEQ ID NO: 31635 - DNA, 4577 bp, Homo sapiens
gaattccgggcggcggcggccaaactccgcggcgtccccagggcgccagcgttcgccctcgccgccgcggccgcgctgctcttcggctccgacatggaagatggaccttctaataatgcgagctgcttccgaaggctgaccgagtgcttcctgagccccaaagctaatggtatagatatagaagtcatccacagagatgttacagttgaagagatgggggtagagaagactttgaaggaaaagaatgtagaatgaggatagaagagaggaaatcccaacatttaacaggtttgacagatgaaaaagtgaaggcatatctttctcttcacccccaggtattagatgaatttgtatctgaaagtgttagtgcagagacagtagagaaatggctgaagaggaagaacaacaaatcagaagatgaatcagctcctaaggaagtcagcaggtaccaagatacgaatatgcagggagttgtatatgaactaaacagctatatagaacaacggttggacacaggaggagacaaccagctactcctctatgaactgagcagcatcattaaaatagccacaaaagccgatggatttgcactgtatttccttggagagtgcaataatagcctgtgtatattcacgccacctgggataaaggaaggaaaaccccgcctcatccctgctgggcccatcactcagggcaccaccgtctctgcttatgtggccaagtccaggaaaacactgctagtagaagacatccttggagatgaacgatttccaagaggtactggactggaatcagggactcgtatccagtctgttctttgcttaccaattgtcactgcaattggtgacttgattggtattctcgagctgtatcggcactggggcaaagaagccttctgtcttagtcaccaggaggttgcaacagcaaatcttgcctgggcttcagtagcaatacatcaggtgcaggtatgcagaggccttgccaaacagacagaattgaatgacttcctactcgacgtatcaaaaacatattttgataacatagttgcaatagattctctacttgaacacataatgatatatgcaaaaaacctggtgaatgccgatcgttgtgcgcttttccaggtggaccataagaacaaggagttatattcagacctttttgatattggagaggaaaaggaaggaaaacctgtcttcaagaagaccaaagagataagattttcaattgagaaaggaattgctggccaagtagcaagaacaggggaagtcctgaacattccagatgcctatgcagacccacgctttaacagagaagtagacttgtacacaggctacaccacgcggaacatcctgtgcatgcccatcgtcagccgaggcagcgtgataggtgtggtgcagatggtcaacaaaatcagtggcagtgccttctctaaaacagatgaaaacaacttcaaaatgtttgccgtcttttgtgctttagccttacactgtgctaatatgtatcatagaattcgccactcagagtgcatttaccgggtaacgatggaaaagctgtcctaccatagcatttgtacttcagaagagtggcaaggtctcatgcaattcacccttcccgtgcgtctctgcaaagaaattgaattattccactttgacattggtccttttgaaaacatgtggcctggaatttttgtctacatggttcatcggtcctgtgggacatcctgctttgagcttgaaaagttgtgtcgttttattatgtctgtgaagaagaactatcggcgggttccttatcacaactggaagcatgcggtcactgtagcacactgcatgtatgccatacttcagaacaatcacacgcttttcacagaccttgagcgcaaaggactgctgattgcgtgtctgtgtcatgacctggaccacaggggcttcagtaacagctacctgcagaagttcgaccaccctctggccgctctctactccacttccaccatggagcagcaccacttctcccagactgtgtccatcctccagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacatagagaccgtgtaattggtttgatgatgactgcctgtgacctttgttctgtgacaaaactgtggcccgttacaaaattgacggcaaatgatatatatgcagaattctgggctgagggtgatgaaatgaagaaattgggaatacagcctattcctatgatggacagagacaagaaggatgaagtcccccaaggccagcttgggttctacaatgccgtggccattccctgctatacaacccttacccagatcctccctcccacggagcctcttctgaaagcatgcagggataatctcagtcagtgggagaaggtgattcgaggggaggagactgcaacctggatttcatccccatccgtggctcagaaggcagctgcatctgaagattgagcactggtcaccctgacacgctgtcccacctacagatcctcatcttgcttctttgacattcttttcctttttttggggggggtggggggaacctgcacctggtaactggggtgcaaacctcttcaagaaggtaacatcaaataaataagtcaagcagaggacttcctgccaatctcttctgtgaggcatcatagacactgagcaaccaggaccacccccacgttcagaaatcagctggccaagtgactccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaatgttcatgtatgacctacttgtaattaacttgagttgtagtccacagcctcaggacaaatgtcgttgaggttacagagtaagaaatgatggcaaaacgtcaaactcttatttcagagcttcatgaatttagttagactaaacataattctttaagttcaacctaaagggctgagatcaataaatttaacactagacgaagtagacttcctgtctttttgagaagagatgaggtatatgttacaataaatctcagaacttcaagtagcagttcaaaagatgtcagtttttaaaattgtttttgttgttgtcttggcagttttactgaaccctttgcataaagaacaaaataaaagctcggcattgtaatttttttaatggacaagtcttatggatacgaagggtacatttttcataatgattcctttatattttcactttgtgtcattgcagaattttagactctcattcacaatgaaaagtttattttaaacattgtttaattaaaataccatacagttctcttttaaacatcaaaccataaaaagtgtattttgtaattttactctgacctgccgcagtcacctctcacttatctcttccacgtactgcacggtcgtatttcatgagctttctgtccatagcacagaaacagagcagaaagtagtacaatcatgttggaccttctttctgttctctttactcttctcacagatcagatcactccatagaagcctgtgggtttcgatggtttcttctatacacctttttggttgaccagtattactatacaatgtaagtgttttaaaaaatacgaaagtaatactctgcaccccttcctacaaagatgataaagcagtcacttctggcgcattttaataatttaaagatttttagtgcaatggcacggtaacctccaaacctgaattagacagagactcactcaggaagtgacaggcccatcatatcaaataacttattcacttttcatgtggcaggaaactggaatatcgcttttaataaaatggaaaaatatgcttctacatatttaccaccataggcgttttgttcatatgagcctggtttgtgcaaaattaaatcagaggcttctacaacatggtttatttatgttgtagcaaagttggctctacataaacattgttcttattttaaaattaacactatgtgttcagttttcttgtgggcttctgaaagttgccatcttccctccgtggagctccatttgctattttcattatacactatgaggtaaaatgtaataacaaaagagagagaagtaccactgtggctagatatatacacacacatatatatatggatggatgtaatatatgtagaacacacacatagatgtatataggatacacactcatgtatgtaaacgtatacatatgtgtatatatgatacatacacatacacacacacgagagacagaaggaaagagaggaagagagaagcaaacatgtaggaaaaaatataaatcagccggaattc

SEQ ID NO: 31636 - DNA, 4449 bp, Homo sapiens
gaattccgggcggcggcggccaaactccgcggcgtccccagggcgccagcgttcgccctcgccgccgcggccgcgctgctcttcggctccgacatggaagatggaccttctaataatgcgagctgcttccgaaggctgaccgagtgcttcctgagccccagtttgacagatgaaaaagtgaaggcatatctttctcttcacccccaggtattagatgaatttgtatctgaaagtgttagtgcagagacagtagagaaatggctgaagaggaagaacaacaaatcagaagatgaatcagctcctaaggaagtcagcaggtaccaagatacgaatatgcagggagttgtatatgaactaaacagctatatagaacaacggttggacacaggaggagacaaccagctactcctctatgaactgagcagcatcattaaaatagccacaaaagccgatggatttgcactgtatttccttggagagtgcaataatagcctgtgtatattcacgccacctgggataaaggaaggaaaaccccgcctcatccctgctgggcccatcactcagggcaccaccgtctctgcttatgtggccaagtccaggaaaacactgctagtagaagacatccttggagatgaacgatttccaagaggtactggactggaatcagggactcgtatccagtctgttctttgcttaccaattgtcactgcaattggtgacttgattggtattctcgagctgtatcggcactggggcaaagaagccttctgtcttagtcaccaggaggttgcaacagcaaatcttgcctgggcttcagtagcaatacatcaggtgcaggtatgcagaggccttgccaaacagacagaattgaatgacttcctactcgacgtatcaaaaacatattttgataacatagttgcaatagattctctacttgaacacataatgatatatgcaaaaaacctggtgaatgccgatcgttgtgcgcttttccaggtggaccataagaacaaggagttatattcagacctttttgatattggagaggaaaaggaaggaaaacctgtcttcaagaagaccaaagagataagattttcaattgagaaaggaattgctggccaagtagcaagaacaggggaagtcctgaacattccagatgcctatgcagacccacgctttaacagagaagtagacttgtacacaggctacaccacgcggaacatcctgtgcatgcccatcgtcagccgaggcagcgtgataggtgtggtgcagatggtcaacaaaatcagtggcagtgccttctctaaaacagatgaaaacaacttcaaaatgtttgccgtcttttgtgctttagccttacactgtgctaatatgtatcatagaattcgccactcagagtgcatttaccgggtaacgatggaaaagctgtcctaccatagcatttgtacttcagaagagtggcaaggtctcatgcaattcacccttcccgtgcgtctctgcaaagaaattgaattattccactttgacattggtccttttgaaaacatgtggcctggaatttttgtctacatggttcatcggtcctgtgggacatcctgctttgagcttgaaaagttgtgtcgttttattatgtctgtgaagaagaactatcggcgggttccttatcacaactggaagcatgcggtcactgtagcacactgcatgtatgccatacttcagaacaatcacacgcttttcacagaccttgagcgcaaaggactgctgattgcgtgtctgtgtcatgacctggaccacaggggcttcagtaacagctacctgcagaagttcgaccaccctctggccgctctctactccacttccaccatggagcagcaccacttctcccagactgtgtccatcctccagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacatagagaccgtgtaattggtttgatgatgactgcctgtgacctttgttctgtgacaaaactgtggcccgttacaaaattgacggcaaatgatatatatgcagaattctgggctgagggtgatgaaatgaagaaattgggaatacagcctattcctatgatggacagagacaagaaggatgaagtcccccaaggccagcttgggttctacaatgccgtggccattccctgctatacaacccttacccagatcctccctcccacggagcctcttctgaaagcatgcagggataatctcagtcagtgggagaaggtgattcgaggggaggagactgcaacctggatttcatccccatccgtggctcagaaggcagctgcatctgaagattgagcactggtcaccctgacacgctgtcccacctacagatcctcatcttgcttctttgacattcttttcctttttttggggggggtggggggaacctgcacctggtaactggggtgcaaacctcttcaagaaggtaacatcaaataaataagtcaagcagaggacttcctgccaatctcttctgtgaggcatcatagacactgagcaaccaggaccacccccacgttcagaaatcagctggccaagtgactccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaatgttcatgtatgacctacttgtaattaacttgagttgtagtccacagcctcaggacaaatgtcgttgaggttacagagtaagaaatgatggcaaaacgtcaaactcttatttcagagcttcatgaatttagttagactaaacataattctttaagttcaacctaaagggctgagatcaataaatttaacactagacgaagtagacttcctgtctttttgagaagagatgaggtatatgttacaataaatctcagaacttcaagtagcagttcaaaagatgtcagtttttaaaattgtttttgttgttgtcttggcagttttactgaaccctttgcataaagaacaaaataaaagctcggcattgtaatttttttaatggacaagtcttatggatacgaagggtacatttttcataatgattcctttatattttcactttgtgtcattgcagaattttagactctcattcacaatgaaaagtttattttaaacattgtttaattaaaataccatacagttctcttttaaacatcaaaccataaaaagtgtattttgtaattttactctgacctgccgcagtcacctctcacttatctcttccacgtactgcacggtcgtatttcatgagctttctgtccatagcacagaaacagagcagaaagtagtacaatcatgttggaccttctttctgttctctttactcttctcacagatcagatcactccatagaagcctgtgggtttcgatggtttcttctatacacctttttggttgaccagtattactatacaatgtaagtgttttaaaaaatacgaaagtaatactctgcaccccttcctacaaagatgataaagcagtcacttctggcgcattttaataatttaaagatttttagtgcaatggcacggtaacctccaaacctgaattagacagagactcactcaggaagtgacaggcccatcatatcaaataacttattcacttttcatgtggcaggaaactggaatatcgcttttaataaaatggaaaaatatgcttctacatatttaccaccataggcgttttgttcatatgagcctggtttgtgcaaaattaaatcagaggcttctacaacatggtttatttatgttgtagcaaagttggctctacataaacattgttcttattttaaaattaacactatgtgttcagttttcttgtgggcttctgaaagttgccatcttccctccgtggagctccatttgctattttcattatacactatgaggtaaaatgtaataacaaaagagagagaagtaccactgtggctagatatatacacacacatatatatatggatggatgtaatatatgtagaacacacacatagatgtatataggatacacactcatgtatgtaaacgtatacatatgtgtatatatgatacatacacatacacacacacgagagacagaaggaaagagaggaagagagaagcaaacatgtaggaaaaaatataaatcagccggaattc

SEQ ID NO: 31637 - DNA, 3140 bp, Homo sapiens
tttgttgtgatttccactcccctcttacccacacataacgggcggcattcgttctgttttcaatgtatcatagaattcgccactcagagtgcatttaccgggtaacgatggaaaagctgtcctaccatagcatttgtacttcagaagagtggcaaggtctcatgcaattcacccttcccgtgcgtctctgcaaagaaattgaattattccactttgacattggtccttttgaaaacatgtggcctggaatttttgtctacatggttcatcggtcctgtgggacatcctgctttgagcttgaaaagttgtgtcgttttattatgtctgtgaagaagaactatcggcgggttccttatcacaactggaagcatgcggtcactgtagcacactgcatgtatgccatacttcagaacaatcacacgcttttcacagaccttgagcgcaaaggactgctgattgcgtgtctgtgtcatgacctggaccacaggggcttcagtaacagctacctgcagaagttcgaccaccctctggccgctctctactccacttccaccatggagcagcaccacttctcccagactgtgtccatcctccagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacatagagaccgtgtaattggtttgatgatgactgcctgtgacctttgttctgtgacaaaactgtggcccgttacaaaattgacggcaaatgatatatatgcagaattctgggctgagggtgatgaaatgaagaaattgggaatacagcctattcctatgatggacagagacaagaaggatgaagtcccccaaggccagcttgggttctacaatgccgtggccattccctgctatacaacccttacccagatcctccctcccacggagcctcttctgaaagcatgcagggataatctcagtcagtgggagaaggtgattcgaggggaggagactgcaacctggatttcatccccatccgtggctcagaaggcagctgcatctgaagattgagcactggtcaccctgacacgctgtcccacctacagatcctcatcttgcttctttgacattcttttcctttttttggggggggtggggggaacctgcacctggtaactggggtgcaaacctcttcaagaaggtaacatcaaataaataagtcaagcagaggacttcctgccaatctcttctgtgaggcatcatagacactgagcaaccaggaccacccccacgttcagaaatcagctggccaagtgactccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaatgttcatgtatgacctacttgtaattaacttgagttgtagtccacagcctcaggacaaatgtcgttgaggttacagagtaagaaatgatggcaaaacgtcaaactcttatttcagagcttcatgaatttagttagactaaacataattctttaagttcaacctaaagggctgagatcaataaatttaacactagacgaagtagacttcctgtctttttgagaagagatgaggtatatgttacaataaatctcagaacttcaagtagcagttcaaaagatgtcagtttttaaaattgtttttgttgttgtcttggcagttttactgaaccctttgcataaagaacaaaataaaagctcggcattgtaatttttttaatggacaagtcttatggatacgaagggtacatttttcataatgattcctttatattttcactttgtgtcattgcagaattttagactctcattcacaatgaaaagtttattttaaacattgtttaattaaaataccatacagttctcttttaaacatcaaaccataaaaagtgtattttgtaattttactctgacctgccgcagtcacctctcacttatctcttccacgtactgcacggtcgtatttcatgagctttctgtccatagcacagaaacagagcagaaagtagtacaatcatgttggaccttctttctgttctctttactcttctcacagatcagatcactccatagaagcctgtgggtttcgatggtttcttctatacacctttttggttgaccagtattactatacaatgtaagtgttttaaaaaatacgaaagtaatactctgcaccccttcctacaaagatgataaagcagtcacttctggcgcattttaataatttaaagatttttagtgcaatggcacggtaacctccaaacctgaattagacagagactcactcaggaagtgacaggcccatcatatcaaataacttattcacttttcatgtggcaggaaactggaatatcgcttttaataaaatggaaaaatatgcttctacatatttaccaccataggcgttttgttcatatgagcctggtttgtgcaaaattaaatcagaggcttctacaacatggtttatttatgttgtagcaaagttggctctacataaacattgttcttattttaaaattaacactatgtgttcagttttcttgtgggcttctgaaagttgccatcttccctccgtggagctccatttgctattttcattatacactatgaggtaaaatgtaataacaaaagagagagaagtaccactgtggctagatatatacacacacatatatatatggatggatgtaatatatgtagaacacacacatagatgtatataggatacacactcatgtatgtaaacgtatacatatgtgtatatatgatacatacacatacacacacacgagagacagaaggaaagagaggaagagagaagcaaacatgtaggaaaaaatataaatcagccggaattc

SEQ ID NO: 31638 - DNA, 4734 bp, Homo sapiens
gaattccgggcggcggcggccaaactccgcggcgtccccagggcgccagcgttcgccctcgccgccgcggccgcgctgctcttcggctccgacatggaagatggaccttctaataatgcgagctgcttccgaaggctgaccgagtgcttcctgagccccaaagctaatggtatagatatagaagtcatccacagagatgttacagttgaagagatgggggtagagaagactttgaaggaaaagaatgtagaatgaggatagaagagaggaaatcccaacatttaacaggtttgacagatgaaaaagtgaaggcatatctttctcttcacccccaggtattagatgaatttgtatctgaaagtgttagtgcagagacagtagagaaatggctgaagaggaagaacaacaaatcagaagatgaatcagctcctaaggaagtcagcaggtaccaagatacgaatatgcagggagttgtatatgaactaaacagctatatagaacaacggttggacacaggaggagacaaccagctactcctctatgaactgagcagcatcattaaaatagccacaaaagccgatggatttgcactgtatttccttggagagtgcaataatagcctgtgtatattcacgccacctgggataaaggaaggaaaaccccgcctcatccctgctgggcccatcactcagggcaccaccgtctctgcttatgtggccaagtccaggaaaacactgctagtagaagacatccttggagatgaacgatttccaagaggtactggactggaatcagggactcgtatccagtctgttctttgcttaccaattgtcactgcaattggtgacttgattggtattctcgagctgtatcggcactggggcaaagaagccttctgtcttagtcaccaggaggttgcaacagcaaatcttgcctgggcttcagtagcaatacatcaggtgcaggtatgcagaggccttgccaaacagacagaattgaatgacttcctactcgacgtatcaaaaacatattttgataacatagttgcaatagattctctacttgaacacataatgatatatgcaaaaaacctggtgaatgccgatcgttgtgcgcttttccaggtggaccataagaacaaggagttatattcagacctttttgatattggagaggaaaaggaaggaaaacctgtcttcaagaagaccaaagagataagattttcaattgagaaaggaattgctggccaagtagcaagaacaggggaagtcctgaacattccagatgcctatgcagacccacgctttaacagagaagtagacttgtacacaggctacaccacgcggaacatcctgtgcatgcccatcgtcagccgaggcagcgtgataggtgtggtgcagatggtcaacaaaatcagtggcagtgccttctctaaaacagatgaaaacaacttcaaaatgtttgccgtcttttgtgctttagccttacactgtgctaatatgtatcatagaattcgccactcagagtgcatttaccgggtaacgatggaaaagctgtcctaccatagcatttgtacttcagaagagtggcaaggtctcatgcaattcacccttcccgtgcgtctctgcaaagaaattgaattattccactttgacattggtccttttgaaaacatgtggcctggaatttttgtctacatggttcatcggtcctgtgggacatcctgctttgagcttgaaaagttgtgtcgttttattatgtctgtgaagaagaactatcggcgggttccttatcacaactggaagcatgcggtcactgtagcacactgcatgtatgccatacttcagaacaatcacacgcttttcacagaccttgaggtacatcatgatgacacagcagcatataacatggaaaccaccccaaaacaaaatgatactaacaacataattaattcagttatcttaagaatgccagaattgggagtacttgagagcttagaccttgaccctcctccaacctcaaactacaaccttgcgcaaaggactgctgattgcgtgtctgtgtcatgacctggaccacaggggcttcagtaacagctacctgcagaagttcgaccaccctctggccgctctctactccacttccaccatggagcagcaccacttctcccagactgtgtccatcctccagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacatagagaccgtgtaattggtttgatgatgactgcctgtgacctttgttctgtgacaaaactgtggcccgttacaaaattgacggcaaatgatatatatgcagaattctgggctgagggtgatgaaatgaagaaattgggaatacagcctattcctatgatggacagagacaagaaggatgaagtcccccaaggccagcttgggttctacaatgccgtggccattccctgctatacaacccttacccagatcctccctcccacggagcctcttctgaaagcatgcagggataatctcagtcagtgggagaaggtgattcgaggggaggagactgcaacctggatttcatccccatccgtggctcagaaggcagctgcatctgaagattgagcactggtcaccctgacacgctgtcccacctacagatcctcatcttgcttctttgacattcttttcctttttttggggggggtggggggaacctgcacctggtaactggggtgcaaacctcttcaagaaggtaacatcaaataaataagtcaagcagaggacttcctgccaatctcttctgtgaggcatcatagacactgagcaaccaggaccacccccacgttcagaaatcagctggccaagtgactccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaatgttcatgtatgacctacttgtaattaacttgagttgtagtccacagcctcaggacaaatgtcgttgaggttacagagtaagaaatgatggcaaaacgtcaaactcttatttcagagcttcatgaatttagttagactaaacataattctttaagttcaacctaaagggctgagatcaataaatttaacactagacgaagtagacttcctgtctttttgagaagagatgaggtatatgttacaataaatctcagaacttcaagtagcagttcaaaagatgtcagtttttaaaattgtttttgttgttgtcttggcagttttactgaaccctttgcataaagaacaaaataaaagctcggcattgtaatttttttaatggacaagtcttatggatacgaagggtacatttttcataatgattcctttatattttcactttgtgtcattgcagaattttagactctcattcacaatgaaaagtttattttaaacattgtttaattaaaataccatacagttctcttttaaacatcaaaccataaaaagtgtattttgtaattttactctgacctgccgcagtcacctctcacttatctcttccacgtactgcacggtcgtatttcatgagctttctgtccatagcacagaaacagagcagaaagtagtacaatcatgttggaccttctttctgttctctttactcttctcacagatcagatcactccatagaagcctgtgggtttcgatggtttcttctatacacctttttggttgaccagtattactatacaatgtaagtgttttaaaaaatacgaaagtaatactctgcaccccttcctacaaagatgataaagcagtcacttctggcgcattttaataatttaaagatttttagtgcaatggcacggtaacctccaaacctgaattagacagagactcactcaggaagtgacaggcccatcatatcaaataacttattcacttttcatgtggcaggaaactggaatatcgcttttaataaaatggaaaaatatgcttctacatatttaccaccataggcgttttgttcatatgagcctggtttgtgcaaaattaaatcagaggcttctacaacatggtttatttatgttgtagcaaagttggctctacataaacattgttcttattttaaaattaacactatgtgttcagttttcttgtgggcttctgaaagttgccatcttccctccgtggagctccatttgctattttcattatacactatgaggtaaaatgtaataacaaaagagagagaagtaccactgtggctagatatatacacacacatatatatatggatggatgtaatatatgtagaacacacacatagatgtatataggatacacactcatgtatgtaaacgtatacatatgtgtatatatgatacatacacatacacacacacgagagacagaaggaaagagaggaagagagaagcaaacatgtaggaaaaaatataaatcagccggaattc

SEQ ID NO: 31639 - DNA, 2437 bp, Homo sapiens
gaattccgggcggcggcggccaaactccgcggcgtccccagggcgccagcgttcgccctcgccgccgcggccgcgctgctcttcggctccgacatggaagatggaccttctaataatgcgagctgcttccgaaggctgaccgagtgcttcctgagccccaaagctaatggtatagatatagaagtcatccacagagatgttacagttgaagagatgggggtagagaagactttgaaggaaaagaatgtagaatgaggatagaagagaggaaatcccaacatttaacaggtttgacagatgaaaaagtgaaggcatatctttctcttcacccccaggtattagatgaatttgtatctgaaagtgttagtgcagagacagtagagaaatggctgaagaggaagaacaacaaatcagaagatgaatcagctcctaaggaagtcagcaggtaccaagatacgaatatgcagggagttgtatatgaactaaacagctatatagaacaacggttggacacaggaggagacaaccagctactcctctatgaactgagcagcatcattaaaatagccacaaaagccgatggatttgcactgtatttccttggagagtgcaataatagcctgtgtatattcacgccacctgggataaaggaaggaaaaccccgcctcatccctgctgggcccatcactcagggcaccaccgtctctgcttatgtggccaagtccaggaaaacactgctagtagaagacatccttggagatgaacgatttccaagaggtactggactggaatcagggactcgtatccagtctgttctttgcttaccaattgtcactgcaattggtgacttgattggtattctcgagctgtatcggcactggggcaaagaagccttctgtcttagtcaccaggaggttgcaacagcaaatcttgcctgggcttcagtagcaatacatcaggtgcaggtatgcagaggccttgccaaacagacagaattgaatgacttcctactcgacgtatcaaaaacatattttgataacatagttgcaatagattctctacttgaacacataatgatatatgcaaaaaacctggtgaatgccgatcgttgtgcgcttttccaggtggaccataagaacaaggagttatattcagacctttttgatattggagaggaaaaggaaggaaaacctgtcttcaagaagaccaaagagataagattttcaattgagaaaggaattgctggccaagtagcaagaacaggggaagtcctgaacattccagatgcctatgcagacccacgctttaacagagaagtagacttgtacacaggctacaccacgcggaacatcctgtgcatgcccatcgtcagccgaggcagcgtgataggtgtggtgcagatggtcaacaaaatcagtggcagtgccttctctaaaacagatgaaaacaacttcaaaatgtttgccgtcttttgtgctttagccttacactgtgctaatatgtatcatagaattcgccactcagagtgcatttaccgggtaacgatggaaaagctgtcctaccatagcatttgtacttcagaagagtggcaaggtctcatgcaattcacccttcccgtgcgtctctgcaaagaaattgaattattccactttgacattggtccttttgaaaacatgtggcctggaatttttgtctacatggttcatcggtcctgtgggacatcctgctttgagcttgaaaagttgtgtcgttttattatgtctgtgaagaagaactatcggcgggttccttatcacaactggaagcatgcggtcactgtagcacactgcatgtatgccatacttcagaacaatcacacgcttttcacagaccttgaggtacatcatgatgacacagcagcatataacatggaaaccaccccaaaacaaaatgatactaacaacataattaattcagttatcttaagaatgccagaattgggagtacttgagagcttagaccttgaccctcctccaacctcaaactacaaccttgcgcaaaggactgctgattgcgtgtctgtgtcatgacctggaccacaggggcttcagtaacagctacctgcagaagttcgaccaccctctggccgctctctactccacttccaccatggagcagcaccacttctcccagactgtgtccatcctccagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacataggtaaaaataatttttaaaagcttagaagcccagaaagtgttatctggaataaattgatacttaagaaatgtaat

SEQ ID NO: 31640 - DNA, 1023 bp, Homo sapiens
gaattccgggcggcggcggccaaactccgcggcgtccccagggcgccagcgttcgccctcgccgccgcggccgcgctgctcttcggctccgacatggaagatggaccttctaataatgcgagctgcttccgaaggctgaccgagtgcttcctgagccccaaagctaatggtatagatatagaagtcatccacagagatgttacagttgaagagatgggggtagagaagactttgaaggaaaagaatgtagaatgaggatagaagagaggaaatcccaacatttaacagctaataaatgaagaaggcatgatagaatgaggaaaatcaccattgtcaagccctactgaattagtcactcaagagccactaatgctgctgacatcacaaaaaacttctgacagaagtgtgcagtaacactgaccagattgtaccccaaatggaacctacatctcttcaggccttgaggactaatgtcaattttcaagaaatgcagagagcggaggaacatgctaaaccccacagggataaagtcagaaaaatccagattgaagtaaaccataggactaaaaacctattttattcagaaataagttataatgggggaaagtaagagatggagggaatattattggaccaaagagacctaaatataatttaaaaaatgaaattccgagctactgcaacatgtggaatttacttgtgtcctagtgcagaccaacaagcagtaaaaaaaaaaaaaaaaaaaaaaaaaggagttttaaggccgggatattctgaggagggaacttaaacaataataattcccttaatgtggcgaaacagacagcataattaacgcgcacaaactagcttctcactcttcggacgaacaccttttggaaagggctccctacttttttaacaataattcggggaattggttggaaactctttcagcacggaagtcgctgcaccacctgaccacttggcttgcatgtagaggtgacctgcgctcaaccatgggccaactttcgcggcacacgc

SEQ ID NO: 31641 - DNA, 547 bp, Homo sapiens
ccagttaaggataatagttacaatggaagaaacagatcaaatttattcaaatatatggtttcgtagtaatactgttattttttagttgtttacccatgggagaatgttactgcatccactcattattttcaaaactggtgaacaaaggggaacaaattaagcatttgtcttgtttgatctacatgaactgtcccaccggacaaccacatagtagatgaagctaagtttctcttcatattatttcagctaataaatgaagaaggcatgatagaatgaggaaaatcaccattgtcaagccctactgaattagtcactcaagagccactaatgctgctgacatcacaaaaaacttctgacagaagtgtgcagtaacactgaccagattgtaccccaaatggaacctacatctcttcaggccttgaggactaatgtcaattttcaagaaatgcagagagcggaggaacatgctaaaccccacagggataaagtcagaaaaatccagattgaagtaaaccataggactaaaaacctattttattcagaaata

SEQ ID NO: 31642 - DNA, 387 bp, Homo sapiens
gtacatcatgatgacacagcagcatataacatggaaaccaccccaaaacaaaatgatactaacaacataattaattcagttatcttaagaatgccaggcgagtatgattgttaacatgatacttcatggggttaggggttactggcgagatttcccttccaattatgtggcgggaaaaaccagttcagcattatcaggacaaagaagcaggcatatcgctaaaaatgtacctgtgagaacttctgctgactcccatcgcagcacccccatctgtctgcatctgccctcagcaggctctgccttgcacacttccttaaaccttcacactcctctccagagctgacccttctgctttattgtatctgtcgcctccacctcttggagaac

SEQ ID NO: 31643 - DNA, 313 bp, Homo sapiens
atgaaaaagtgaaggcatatctttctcttcacccccaggtattagatgaatttgtatctgaaagtgttagtgcagagacagtagagaaatggctgaagaggaagaacaacaaatcagaaggtaaggtctcttgtggatctcattttaaaccagctttttctatcttacggcaaaagactaagcatttaatatattctagagtgtgaaatataaagtagacaaatattaacactgtaattctatcagagttattccatttaaaaagataaagtaagttagagaagaaataaatacaaaagaaagatccgtgact

SEQ ID NO: 31644 - DNA, 694 bp, Homo sapiens
gccgactactaactactactaaattcgcggccgcgtcgacggctgtgacaaacaattggtttgtgttttgaattattcatggcacaaacccctcctgaaaacaccagactagacttttctgatcatgaagggtgagtgcaggcctcgatggtcttcaggtctcttctggctgcagcattctgtgagtctgtgaaatcaaacagtgtctataaaagggtttgtccttttctttcttcagttaatgattgtggatgaggattctttgcactggtagacactagtgttttgatgacatgaagacagaagaagaagtagcattagttaattcaaacaagcctgtattgatcttgtaaattggctaaaatctttgttgtactaaagagattgcttaatgtttttgaatcctattctttaaaatgttttggtttgagtaataaagctaaatatcaccagaaagataacttattgaaaattgtaaaagtatttctttgagaagaaatgcataaagtattttcaaatagtctcatttacttcctgtaaaacatggtgaggctaggtgcagtggctcacgcatgcaatcccagcactttgggaggccaaggagggagtatcccttgtacccaggagttcaagaccagcctaggcaacatagtgagacactcaacaccacaaaaagaaaaagcatgacaagaca

SEQ ID NO: 31645 - DNA, 244 bp, Homo sapiens
gcatctagccctggaagaaatgatgcaacatcacaatgtcatcaaaggccgaacgtgtaaatcaactctgctttgcatgtttattccaagaatgagcacagtagacatagcagaaccagatttggaaacggcatctctaattttgtttggccaaatttgccaagcataatagattatgagcccttatgggtgttcccaagtaattacacttaattgtttgtgcaaatcagaggatctatgagct

SEQ ID NO: 31646 - DNA, 775 bp, Homo sapiens
aatgccttctaaataggaattttgttctcctcatgttgttttcttctcttcatttctggtacccaaccaatatccaagattagatccctctatataaatgaaaatgtataacctttaaaattattttcttttggtctttttttctaccaagtaagaactaaaaaagattaccatccccctcagcatttcactagtttttgttcaaacagcacacaaacagaattatttcaagatatttagctaattaaatttgattgtgcaattcagatctatataaattaaccttagcattattcctgtgctttattattcactgataggttcttattcaactaatgtttatttcttgcctaatatgtgccagaaaccgtgaagtgtttaggatatgcagtgagtggttaatgagacaagtatgatccaacttgtgtttgcaattaagcagggatacaggtactgaataaatactgaaaataattaaaatggtaataagtgatttgttaatactgatgcatgtagatctaattcattttaaatgttacaaaataagttacaaaatggtatatgccatatgatgctatttttgtacatctataataaactttatgagacacaaatatgcaatgtagttactaataaaactataagaacaagaacaccaatctttagataaagcttactgccaggagggaatggaatggatgcagagagcatggttagctgtatctttaatgtttcatttctttaaaaaatatttcagcaaatataatgataatga

SEQ ID NO: 31647 - DNA, 543 bp, Homo sapiens
tttgctcaaattcagactctggtcttcaggccagaaaaggatcccctgctgccaaagtgaataaaggaacaaatgccaaaagtagcttgcccacttgatggtggggagatgagcatctttaaactgggggcagaggccctcactccaggtggagacaagactgcaaaggcaaatactttgatggagaacatagcaacaacttaaactataggactacaccaatccttgctactcaaagtgcagcccatggacaagcagtattgtcataacctggaaatgagctagaaatgcaatctcaagagccatcccaatccgcttttcagcaagatcctcatttgcttggtatgtacattaaagtgtgagaagcattggcataaatgacagatatcatctcctctgtggaaaacagattttgcaggatcttgaacttttgagaaggaaaaagaaaaatgacatgaaatgaggagagggagaaggaagagggagatgtaagaaggacacagatcactagtttgccctggggtgccctgcattctcagttct

SEQ ID NO: 31648 - DNA, 419 bp, Homo sapiens
gaaagcaatgtttgttctatgaatggcctgtgtgctcacagagaaagatggctgagtaagggccatcttacttttccttttccactggattgattacaatgagacaatctttttatgccaaagattatctcaatgttctatatacaatgttctacatacagctaattcccaagggaattaggtctaaatttaattttaaccactgcatttcatatttttcaggagttatatttgtcatttggtttgtaatatctactctctgatctaaactattcacttctgccttttatttttgtgctcatctggaagctaaatcaacaaaacagcttggcatagtaaatcatatgttctcaccataaagtttatcatattttttaaagtaaaaaaaaatcactcaaaatattctataagcaacagta

SEQ ID NO: 31649 - DNA, 199 bp, Homo sapiens
atttaggatctctacccttaaataagtgacaaaaactttctaatttaaaaaaatagataattcaaatttcttttaaacctttaatgttctcttgactgatctattttgacttaagactgccaacaaacagttaactaggagcagctacctctgcaattgctaataaggaaagtaagaatagaaactctttcatcctatt

SEQ ID NO: 31650 - DNA, 392 bp, Homo sapiens
caaacagcaaagatggcggcccccttctcccccagggaacttatcccagggagaattcaaatctccgtcagcctgagagcacctgccggagtagcagcaggccccagttgggaggtcccacccagcgaggaggaatggattggggacccacttaaagaggcagtctggccacattttggtagagcagctgtgctgcgtgggggatcccttctgccctcagttggtttgggttctcaaaagcccaacaggctggaatagctaagttacccaagcaacaaagatggtggcctgccctgtcccctaggaagtcagtctcaggtaggtaaaacactgttgctggtggctggctggagttgtttccttgattatatgagtaatgcgagtacctggtt

SEQ ID NO: 31651 - DNA, 1327 bp, Homo sapiens
gaacatttgaaatttattctcttgacaattttgaaagatccaatacactattattaactatagtcactatgctgtgcaatagatctcaaaagcttattcctcttaactgaaacctactaccctgtgacatgtggggaacatctctctattccccagccccagtccctaaatgttgaatacacaatggggaaaaaatagtcttcaatgaatggtggtgggaaaattgtatatccacatgcagaagaataaaattggacccttacctcctaccatatataaaaaccaactgaaaatcgattaaagacttaaactgtaaaactactaaaagaaaatatagggagaaagcttcacaacgttggtctgggcaataatttttggatttgacctcaaaagtagatgcaaccacagtgaaaataaacaaatgaaattgcataaaataaaaaatgtttctgcacagcaaaggaaataattaatggagtaaagagacaacttacagattgggagaatatatttccaaactattgttggggctcagaaacggataccctaacatatagtgatttgacaggtggaactaaagaagactcgaggtctctctgacctcctcctcaacctctgtttcttaatcctctgttttcccagagcacaggaggaagttctctgaagttcctttatctgctttaagttcagactcaccaaataagaaaacagttaattctggtgccttccatgggttttcattaactgaagtcatattgtaggaaaaagaatgaagtctcttaacccacctggatagatttttctcacaaaccattgtcttctctgcaagcccagtagactttgtcccaggccatttatgtgaatcttcaccccattaagttctccccaaattatttactcttcccccaaaatcacccacacttccccatctccctctcccctaaggacaagggtatatcaccatctataccccattgcttggtggggtgatcactctgattctctgcatgcatttttatagatttgtttgccatttatcctattaatctgcattctgtcaattgtggcaagttatcagcatattttttaacttttaattattattaatggaaagacacttctgtatacactggaaatctcaggaaatttcttttttccttaagcttaattgaaatgtttacttttcagtaaaatttcaagcttgagtaatgttcatgcctgcttttcattgaaatagaatgaaaaggttgcacaatattattttcatgaaattacttctagtataattctgaataaacactttgaaaggcagtgaactgtaaatata

SEQ ID NO: 31652 - DNA, 1276 bp, Homo sapiens
tttaagtgttaaattcaatatacagtaatctgtacttcaaaagtttgtttcttgcttttctaagggcagtactaaataataataacaataataatccttgctaaaatttatgaattcttactctatgtcatgcaccatgtagatttttcacatatataatctgtttaacaaccctgggaagttcatattattatctccattttacatatggtgaaactgaggcttagagcagttaaataaattgcttaagatcatatggcttgttggtggcagatctggaattttctaactcagaaccctgcttttagctggacatggtggtacatgcgtgtaatcccagctactcactcaggaggctgaggtgggaggatcacttaatcccaggagtttgagaccaacctaggcaaagagagaccccatcttaaaaaaaaaaaaaagaaagaaaaggaaagaaaaaaaagaaccctgcttttaatctaaccttgggctagattcttgatacttttttacagggcattttttcctcactactcaagtatacctaagtaggaaataaaacttattttaatattcatctaagtgaaatataaaaagaaaacctataaacctattcttcaaaaaactatgctatattttaatgccatcccaaaatatcttgaattatctatggctcatttctataccattgcccccttttctttaaagctgtagcatattgagaattgaatatgacctttctgagccactcatttctgaatttttaattttaaataaaaatactttttcagattgtttcagatttttagagagggtaaagcaaaatagaaacataaaatatgaaacatacgagtgtatgtatatatgtgtatgcatatatattgatatataaaatgaatgccttaacagataatgtgcattacaattgctgtttcacacttttgttggtattattttaattacactctgacaaaaagttcagcataaaggaaaattggccagacacagtagttcacgcatataaccccagggctttgggaggccaaggcaggagaatcgcttgagaccaggggttcgagatcagtctggacaacatagcaagacccatcgctagcaaaaatttaaaaattagcccagcatagcagcatatagctgtaggcctagctactcagaagaccgaggtgagaggattgcttcagcccaagagtatgaggctacagtgatctgtgatcgtgccactgcactccaacctgagtgatggaatgagaccctgtctcta

SEQ ID NO: 31653 - DNA, 899 bp, Homo sapiens
agattactgaagtagaaatgagcctaagatataccaaaaagaaagagaaagctggcaaatttccgggaagcaagagcaagtaggggccaggtgcagtggctcatgcctgtaatcccagcgcattttgggaggccaaagtgggaggattgtttgaggccaggtgttcaagaccagcctgggcacatagtgagaccccgtttccacaaaaaattttaaaattaactgggcatggtagtacgcacctatagtcctagctatttgaggggtgaggtaggaggatcgcttgagcccaaacgttcaaggctacagtgagctatggtggtgccactgtacttgagcctgagtgacagagcaagactctgtctttaaaggatttttttttttcaaattttttaataaagcaaatggctgggaaaaaaggtgagaaactgctcgcttggatttaagaactgctgctacttgctgtgtgacctggactagttttttgtttgttagttttatttttatttttgtttttttgctgggctttaccttggttttaattttctgaacttcattctgctcatctgaaaaatgaaatactaatgtcttcatcttagtgtaatagggatgattaggtaaggtcaaatatatggaagcatcttgtaaactgtaaaggtatgtaaaaatgtgagggtttgttttttgtgtgtgtatgtgctcttaatgcccaagatgcagagtagaaattaggcagctgggatgccaaacagccaggatgcaacatattggagagaagagccagatatctgaggaggaagtcacaccatcattgccatccatgttgtgatagtcaacagaaggagtaaaaagagacatcagaggaatgaaagggaggaatgaggattgggaaggaacga

SEQ ID NO: 31654 - DNA, 475 bp, Homo sapiens
aatactttttaaaattagcttttcagtatttcattagaattttaaaacttctttgacttttaaaaaattaaataatccaaatattattaaaagcaaaatgcaggggttttcctgctgcccctctgagtttaggagcagctgtcctgctccatggttgcccccttgatggaactggaagttgcctgcctgtcttctcttttttcttccatttcttcttcagactcttccttggcttagcacacctgactcccttccacatcagggataaatgcatacagggaggggaaagtggagaaggagggaccatgcaactcgtccaactcctctccccattcgtggacaagctcttcaccattccctctccactcatatagactccctggtctttccattgtcttcagtctctcaaatcccaccttatttgtgttgtttccaatttttcttgacaattacaaataaagcttctataaacatt

SEQ ID NO: 31655 - DNA, 366 bp, Homo sapiens
ggatgggggtatggttagtggaggggagattgttgataggactcaaaagcaatttaggaggaaggactgaccagaattggggactgatgggtggggcagggtggagtcaagatgatgcccagatttctggctctggcttctgggtggagaggagtgtcatttacagagagggggagccgaggggaggagcaggactggaggagtgctcagaaagggtgagttgccagagtggagggcccacggcagaccctgaagcacctgcttgggatttgtggagtcagacaaacctgagggtgaatcttggctcaaattacaaggtgatggcagaggctgaagacagggagggtgagcaaaggctgcagagga

SEQ ID NO: 31656 - DNA, 583 bp, Homo sapiens
aagctatttcaaaatgtaaaaacataaagtaactatgtgactctgcaagtgaactcctagaaagatacccaagaaaaatgaaaacacatgttcacacaagaaatcgtacattaatgtacatagaagcattactatagccaaaaagtggaaacaaccaaaatgtccatggactgacgaacggataaacaacgtgttatatttatgcagtggagtattactcagcaataaaaagagtgaagtctggagccgggcgcggagcgtcacacctgtaatcccagcactttgggaagcagaggcaagacaactgcttcatcccaggcatttgagaccagctttgggcaatgtggtgagaccctgtctctctttctaaaaaaaaaaataataaaaaaataaaaatagatgggcggtagggggaatccaaatgaggtttatattttgcagttagtcgatttaagtcccttgacttttaggttcccattcctttttttatcttccccccaccccctaccccattggttgaagaaactcttttatcctgtcatgtttaggttggctgacttcatccttgaagtacagtacatgt

SEQ ID NO: 31657 - DNA, 1470 bp, Homo sapiens
gtggaaagcgagagtgtcatggatgggttgtggctatgtcagtaaccttacaactgagattttaaaaggcaatgacaaggccgggcacggtggctcacacctgtaatcccagcactttgggaggctgaggctggtctcgaactcctgacctcaggtgatccacctgccttggcctccaaagtgctgggattatgggtgtgagccagcatgcccagcccactgatgttaaccttgatcacctggatgaaatagtatttgttagtttgcaccaccacccctccctgccaatactttgcacaacccgtacttaagtagtggagaattacgctctatctccttgagggtggaccgtctacataaattatttggaatttctctccttggagatctgttcaatcttccctatttgttcagtcatttggcttgtggatatttattttgtactctgagctatagtctaatactactttaactattttgctgttctgatgttccagctttggctgttgggggctcctgtgtccctttggtcactccatcattgtgtgtttctgtgtgtggtggttttttgttggttggttgcgattggtttttcctttttgagtacgtactttctggcactacaagatatttcaggattatcttgtagaattgctgcttcagtccttgaaatagctatttgtctaaggagctttggttccttttattggagaatggctcaggcactccatctgccttggcctcccaaagggctgggattagaggtgtgagccagcacgcctggccaatatttcacatcttaaaaactttatgaaatggataatttttaagcatttacaaatgtagagagaatagtataataaatctccccatgtacctatcccctaacttcaattatcagcttaaggccaatctcattttctctatatctatcccacctctctctatcagataatttgaaacaaatcttagataagtaatttcattagaaattatttcagcatgtatctctaaaagatatgggcttaaaaaaatcaatatcatcacatataaaaaattctcataaaccatgaagtctgttcaaatatcttagttggttcacatttgaaaaattgtattaggatccaaataggctggatgtggtggctcatgcctgtaatcccagcactttgggaagcagaggcaagacaactgcttcatcccaggcatttgagaccagctttgggcaatgtggtgagaccctgtctctctttctaaaaaaaaaaataataaaaaaataaaaatagatgggcggtagggggaatccaaatgaggtttatattttgcagttagtcgatttaagtcccttgacttttaggttcccattcctttttttatcttccccccaccccctaccccattggttgaagaaactcttttatcctgtcatgtttaggttggctgacttcatccttgaagtacagtacatgt

SEQ ID NO: 31658 - DNA, 310 bp, Homo sapiens
ggtcgacgtcttgccaggcttcagagttgtgagaaaatacatttctgttatttataattccctggtgtgtggtattttgctatagcagcacaaatattttaagagcattcatttctccatatcataaccagtaactgaatttcttaatactactttttggcaaatatggttgtcctgcaattcaaacatcctcagtattgctggcagaagtatgaactatgtctcctgacaatattctctccatcttattgcctacagaaattcatgaaaggatcaaatgtaaatggactgacttactccatttgtgctg

SEQ ID NO: 31659 - DNA, 498 bp, Homo sapiens
ttctaaaactgtatacatgcttggtaaatacagagttagaattaggaagagtgttgttaaaaatcattccctattctacttattctcatcaaaatggagtttcttagacactgctattccttcacatattctgatctctcttttgttgagcatcttgcgtgaaggtagactagagttttctcagtctagaattggttacctgttaaatatctaatggttctgtattctttcttacacactagctttagttctgtaggctggttcctggttcacagtcgttttagacactttgtcagactaagttgcttttggctcagtttgtatcacagcaagcttaacaaatgttaacatgataagtcctagttcgctttttttgtagaaaaggtaaggctaatggtattgttactaattctggaaatgcctcctctgcttcccccaactggcagtgatccttatttcttcctaagctttgggcagattcaggtgatccttgggcag

SEQ ID NO: 31660 - DNA, 595 bp, Homo sapiens
aggtaaacatcaaatgtgaaatctagggacaggcaagtttttgttgagaataacaaagctggggtatgagttgaactgaggcagcatatgtcataaaatgtaggctgttataagataaaaacacacttatatattggattgctttgaagtcaagtgtggtaaatgtgttgtagtgtgaatttccaagagaccacatactgaagagctttcctatcctgttgaatgccttttccccagaatggggacagtcacaaaaatctttcagtcccaatgtgtctgtctaggagagaaaaagtgcccacacttctgaaaagcattcagatccaccttctgtatccccattggagaattaagaaattactctgcagggaaagccactaaaaccagtatcatagaggcaccagggcaacctcttaggaactgagatgggaaaagaggtcttcttctaagttccattgagaactacctcccctctctttcttatttaatcacagccttaatctgcagttcaagtcagcaaatctggaaggtgataacaccaaaagagaacattggagctgtgggagggaacaactggggaaaacaagaggactcc

SEQ ID NO: 31661 - DNA, 393 bp, Homo sapiens
ctcccaccttggcctccaaagtgctaggattacaagtgtgagttatcatgcccagccaaaaataattttttatagttttatacttattccatactcaaactctccagttttgaaaaataagtcctttataactggtttgtccaaattaggatccagttgaggaccctatattgctagtggttatgtcctttagggctctttaaatctgatctccctttttaatgtcattgacttgttaaagaggctggacctattgataaatgagaatatttatttaaacttacttaaacattaaatctttaagcttacttaaatatttaagaatatctctttacatttattcagaacattttcttacatagcaaaaattctattcaaatttttgcaagttaa

SEQ ID NO: 31662 - DNA, 653 bp, Homo sapiens
tcatgattctgtgggttatcaatttaggctaggcttggctgaggggttcttctggtctaagctatgctgcctcatgcatctgtggtcagctgcagaatagcttgtctgatcttggctgggttctctcacaggtttatggcctgtggtcagtgtgatctctcatctccaacagggtaacttgggcttgttcacaccccagagtctgaggttcttagagagaaagcagaagtgttcaagccctcttgaacgaaggactatgaatctgtgtaccattacttctgctatattcttttggccagtgcaagctaagccacagtctaggccagattcaaagggtgggaaataaacttcagtccttgataggaggatctacaaagtcgtatgcacaggatgtggaaacggggaggagtgaagatttttgggcagtttggaaatttaccacagtgtacacgtgtgtttacatatgtgtacgtagatgaaaagtgagagcatatacattctgcatttttatcaccagacatgctccaaatccaagttactaatccaaccctgtggatatattggggaaagtaagtaaatcttaaatgggaagtgcctcaacaagtatctagaacaataccttccattcaatcaatggaaggcttaaaaaaaaa

SEQ ID NO: 31663 - DNA, 465 bp, Homo sapiens
atttaaaataagacaatagttttaaaattttaaaatgggtaaagtttggcactagaaaatttaatctcaattgtatatttataggatcttcagattactaaaaagatttgagataatgctggaaaaattggattcacacaatttcactcaatgtttgtctgagagatgagacagttttgaaaagctactttattgtaatacattcatcaatattggaaatataactttatttaataaaaagagccccagactggacattggcaggtttgaaatgagttttttctcattagcttttgaccttggatgggatggtaagttttagaaatcagagaacatgtacatttatacattgttgtatctacactgccttgcacattgtgactgcttcataaatatctagaattaacttttatttcttattttacaatacggaagtagtaaattttctctacctaattcttaaaa

SEQ ID NO: 31664 - DNA, 276 bp, Homo sapiens
agaccatcctggctaacatggaatgtgtaagttggagtattttaattacataaaagtagatcaatatcttcaagatgtctgtttgtgttctgaagagaaagaatcgcgctgcaaacaagcacagcatgcctttccatctgaggaagccagatttaagtaggaaaacagggtctctaactcagttacatctaatacaagctgtgcaatcaccttgagtaccagtcttcttactgagaaatacaattgctgtgaggattaaaataaatcatattcaga

SEQ ID NO: 31665 - DNA, 479 bp, Homo sapiens
ggggctcttggctttaacgaatttactgtatctaaaagacatcttagtacaggaagaaaactaaatctgtagcatgtaaggagcagttttatttgattggtatattcaggtttctaaccagctgaaaaattcaaatacatgccctttaaggattaagtttaaaccacactacagaaagagaaaagatttatatgatcacatataagcaatggaatcagcaatatgagtacttttcacaactatacaaatcaaatttaataatctccagaacattaaggaagttcagcccttaatggaaatgaatgaaaagaaattattcacccactgttacatgccctggaaagagaatgtcctgccagactcaaaagagtatcacaatattactcagattttcagcaatgaaggccctccgaggatctaatgatgttcatattttcagtttatttccttcactgataaacattgttaatagataaaat

SEQ ID NO: 31666 - DNA, 489 bp, Homo sapiens
atcctttacacaggtggatagaaaacgggccgacagtcagtccactcataatagctggacaaatgtttccttgtttaaggatgcataaagactaaaaaaaggctgtggaaaagtcctgcagaacaaggtaaaagcaagagcttctgtagactgagatggagtttctattttgaaaaaccatctacagcagactccagaagatagttttgggaaaatatgtggcatcctcagtatacagcaaaaggacatggtctcccagggccaggaacagtaaaacgtgaagaaaggatatttgacatggaaaagcaacagaaagggaaaagcaaggagatggattccataaggaaaggttttaaggatccaatagcagaactaaaatccaaattagcaagagtatagaaaagtattcatgtatagtaaactgaataatggcctccaaaagttttccatatcctaatccttggcacttgtgaatgttacctcacatgg

SEQ ID NO: 31667 - DNA, 486 bp, Homo sapiens
  misc_feature (25)..(25): n is a, c, g, or t
aaactatagtgctaggtacgaggcntgggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaa

SEQ ID NO: 31668 - DNA, 632 bp, Homo sapiens
gttgcgtggctcgcgttgacgaggtgtgcaagtgtctgtggggtcaggtcctaaaatcagttgccaggtcagcaagttctgtgatgttcttatgcactctgactgggctgtacgcctgcgggaaaggagtaggcagggctcctgcggtggaattgctgttgtgtggtcagctgcagtggtgacttgtgttcaccctggaaaccacagcagcactcaacctcaggaaagtgctcagattgtgcgggcatgtagtgacactacagatgttgctatttattacgacttgaggagtatagatttcttatattttaaaaagcgtgcagttgttgggctgttagtttctcgccggtgagagaagttgggcaagcatgtggctgctctcccctgagcggtagctgcgtgtcctggctgtaaggacgctgtagctggccaggcgattttgcacggtgcagcctgggccgctgctcctgctgcctttcagtgcttgttccccttcacctttttgggggacctgttactccgactcttacttgtctgtcggccttgcagggatgctcccatttcccagtagcctccaggcctgcaggttcccatgacccacagccgggccaccgaggacgggttttgggtcc

SEQ ID NO: 31669 - DNA, 309 bp, Homo sapiens
ggcattcggtctcccatccctcttgttctgggcaccaagcgtaagctgccgtcacctcttcaccagccctaaatatgggtgcccctctcccacagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaagagcctctcagtagagggaggggctgccctgagtggagtattaaagacacttaagaaa

SEQ ID NO: 31670 - DNA, 2347 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaa

SEQ ID NO: 31671 - DNA, 3380 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtaagtggcttctctggggagagtcctctggggggcaggacctctcgtcagccctgccagccacctgccaggcccagggctgccctgctttatgacgaggccatgtgaagcactgcgatgcagtcccccaggcccctgccacaaccctcagccaccctatagctgttgaatgggataccattcaccagggctgccagggagttgaaggtttggcgggcttccatggtgtgattgccaccctaaacccttgaggaaggacaaaatgcacaaacagctttgtcctcgctggcgcagggctgttcatgtgtgcaccagcccccttcttcctgagtgccgtctgtgcctcacattccgtgtggtctatggggcagtggggcagctccctcaggcccctttgcaccaagagtggcagtctgggttctgctgggggcggtgacctcgatacccagcaaggcccagggctcctgctgcaccccaggcactgggcagagagcaccacaaaggcagcagcgtgtgtcctcgccaacagtccgcatcccaggtgctgcattcgtgcccttttgggggaaggtaagatagaagtttacagaatttaagcatctgtggggccaggcgtggtggctcacacctataatcacagtactttgggaggctgaggtaggaggatcacttgagtccaggaggctggggctgtagtgagctatgattgtgccactgcactccagcctgagagacagaacaagaccctgtctccaaaagaaaaagaccataagcatctggagcacctgcaagagcctgtgcatgggctcggcgtgactgagagtcctccgccttgcccgagcatcaggcaggccctcccaagacccctcaagatgctagaatgggactttctgcaaagtttaaacatctgtacaggatttagcttctttggtggcgaacttggattgtgatgccctcaggaagtctggtttcactctttctgtcactgtacgtcagcattcatgaaggacttgtattttctctgccttgtgaggtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaa

SEQ ID NO: 31672 - DNA, 2485 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcagaaattagccaggcgtggtggtgcacacctgtgatcacagctactcgggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaa

SEQ ID NO: 31673 - DNA, 2268 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgctcaatggattactttggtttctccgagttccctgctaccccgtttattggaggc

SEQ ID NO: 31674 - DNA, 3098 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtaagtggcttctctggggagagtcctctggggggcaggacctctcgtcagccctgccagccacctgccaggcccagggctgccctgctttatgacgaggccatgtgaagcactgcgatgcagtcccccaggcccctgccacaaccctcagccaccctatagctgttgaatgggataccattcaccagggctgccagggagttgaaggtttggcgggcttccatggtgtgattgccaccctaaacccttgaggaaggacaaaatgcacaaacagctttgtcctcgctggcgcagggctgttcatgtgtgcaccagcccccttcttcctgagtgccgtctgtgcctcacattccgtgtggtctatggggcagtggggcagctccctcaggcccctttgcaccaagagtggcagtctgggttctgctgggggcggtgacctcgatacccagcaaggcccagggctcctgctgcaccccaggcactgggcagagagcaccacaaaggcagcagcgtgtgtcctcgccaacagtccgcatcccaggtgctgcattcgtgcccttttgggggaaggtaagatagaagtttacagaatttaagcatctgtggggccaggcgtggtggctcacacctataatcacagtactttgggaggctgaggtaggaggatcacttgagtccaggaggctggggctgtagtgagctatgattgtgccactgcactccagcctgagagacagaacaagaccctgtctccaaaagaaaaagaccataagcatctggagcacctgcaagagcctgtgcatgggctcggcgtgactgagagtcctccgccttgcccgagcatcaggcaggccctcccaagacccctcaagatgctagaatgggactttctgcaaagtttaaacatctgtacaggatttagcttctttggtggcgaacttggattgtgatgccctcaggaagtctggtttcactctttctgtcactgtacgtcagcattcatgaaggacttgtattttctctgccttgtgaggtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaaagtacggttgcacgtgcaaccgtactttctccgggagggccatgggtcttctagtttggacagagaattagaaagagagaaagaacgcctgcgactagagcgtgaagccaaagaaagggagaaagaacggcgaagatcccgaagtattgaccgggggttagaacgcaggcgtagcagaagtaggga

SEQ ID NO: 31675 - DNA, 2539 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtaagtggcttctctggggagagtcctctggggggcaggacctctcgtcagccctgccagccacctgccaggcccagggctgccctgctttatgacgaggccatgtgaagcactgcgatgcagtcccccaggcccctgccacaaccctcagccaccctatagctgttgaatgggataccattcaccagggctgccagggagttgaaggtttggcgggcttccatggtgtgattgccaccctaaacccttgaggaaggacaaaatgcacaaacagctttgtcctcgctggcgcagggctgttcatgtgtgcaccagcccccttcttcctgagtgccgtctgtgcctcacattccgtgtggtctatggggcagtggggcagctccctcaggcccctttgcaccaagagtggcagtctgggttctgctgggggcggtgacctcgatacccagcaaggcccagggctcctgctgcaccccaggcactgggcagagagcaccacaaaggcagcagcgtgtgtcctcgccaacagtccgcatcccaggtgctgcattcgtgcccttttgggggaaggtaagatagaagtttacagaatttaagcatctgtggggccaggcgtggtggctcacacctataatcacagtactttgggaggctgaggtaggaggatcacttgagtccaggaggctggggctgtagtgagctatgattgtgccactgcactccagcctgagagacagaacaagaccctgtctccaaaagaaaaagaccataagcatctggagcacctgcaagagcctggagattgagctgcagtcccatgctcagcattga

SEQ ID NO: 31676 - DNA, 2029 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaa

SEQ ID NO: 31677 - DNA, 1566 bp, Homo sapiens
  misc_feature (53)..(53): n is a, c, g, or t
atgtaagtagaaaatgcttgtctatgcgttcgtttgctccttgcctgttgtcntggattgttgatgggatggctggatcttgggcagccatattgaatcatgaggtggaacccatactgaggaaggtggaaggtaaagctgtccatctgacccatcttaagatgggtcagatggacagggtgcgttccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaa

SEQ ID NO: 31678 - DNA, 1885 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgaatgtagtaagaaaacaaaaactgatgaccaagagaatgtgtcagccgatgcaccgagtccagcccaggaaaatggagagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaa

SEQ ID NO: 31679 - DNA, 1885 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgtgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaa

SEQ ID NO: 31680 - DNA, 2020 bp, Homo sapiens
ggcattcggtctcccatccctcttgttctgggcaccaagcgtaagctgccgtcacctcttcaccagccctaaatatgggtgcccctctcccacagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtaagtggcttctctggggagagtcctctggggggcaggacctctcgtcagccctgccagccacctgccaggcccagggctgccctgctttatgacgaggccatgtgaagcactgcgatgcagtcccccaggcccctgccacaaccctcagccaccctatagctgttgaatgggataccattcaccagggctgccagggagttgaaggtttggcgggcttccatggtgtgattgccaccctaaacccttgaggaaggacaaaatgcacaaacagctttgtcctcgctggcgcagggctgttcatgtgtgcaccagcccccttcttcctgagtgccgtctgtgcctcacattccgtgtggtctatggggcagtggggcagctccctcaggcccctttgcaccaagagtggcagtctgggttctgctgggggcggtgacctcgatacccagcaaggcccagggctcctgctgcaccccaggcactgggcagagagcaccacaaaggcagcagcgtgtgtcctcgccaacagtccgcatcccaggtgctgcattcgtgcccttttgggggaaggtaagatagaagtttacagaatttaagcatctgtggggccaggcgtggtggctcacacctataatcacagtactttgggaggctgaggtaggaggatcacttgagtccaggaggctggggctgtagtgagctatgattgtgccactgcactccagcctgagagacagaacaagaccctgtctccaaaagaaaaagaccataagcatctggagcacctgcaagagcctgtgcatgggctcggcgtgactgagagtcctccgccttgcccgagcatcaggcaggccctcccaagacccctcaagatgctagaatgggactttctgcaaagtttaaacatctgtacaggatttagcttctttggtggcgaacttggattgtgatgccctcaggaagtctggtttcactctttctgtcactgtacgtcagcattcatgaaggacttgtattttctctgccttgtgaggtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgctcaatggattactttggtttctccgagttccctgctaccccgtttattggaggc

SEQ ID NO: 31681 - DNA, 1657 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaa

SEQ ID NO: 31682 - DNA, 967 bp, Homo sapiens
  misc_feature (365)..(365): n is a, c, g, or t
  misc_feature (791)..(791): n is a, c, g, or t
  misc_feature (829)..(829): n is a, c, g, or t
tggaacataaactcaagatttaatggtcttcataataaaagatgacacttaaaacgggatcactgggccctttctcttcttatctcctcccagttcaaaaggctggcatctttaaatagccagcattctcttagatctgcagtggggctcaacgcactcaagccttagcacaatcttcttggtagtttatagccttttcccggaaaatcggcttagttggcccaccatagccactctgcttcctgtcataacgccgcttccccggggcgtacagagaatcctggcccttctggtacggtgtcactttatgggggtgggtgctggccacacttcttacagaaagtccggggggtttcagggacgtnaaaccatgctggcgtgagcggggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaaaaaaaaaaaaaaaaaaaaaaaaaacgttgtgtgggggggcttgggcccttggaaaaggtttttgaagaccntttggtgtggggcgggggggccccaatgttggtgttangtggaaccgggggccaaagaggtggttccctagagggaacaccggggacaagagacactagggctggtggatttctccacaatattaaaaaaagcccgggggggacacggatccgtttcggaacaaattcccaaatgg

SEQ ID NO: 31683 - DNA, 204 bp, Homo sapiens
agctgctcagtggcagagactgtcctgcttccagccccttgagcaccaggcctggaccctggtattatctccaatgtttactgtgaattctgtatatgggtgttacctctctaaagaagcacattaaagagtatttgttgaataatcatgctgaaacgtcatctttcatagaagggagaattccacaagttggctgatgccaag

SEQ ID NO: 31684 - DNA, 188 bp, Homo sapiens
aaaaataaataaataaactaaaagaaaggatagaaatacatgagcttcattggtcagaatgtgcacattttcttaagggagacgaagtaaaagttcattgataatgttcctttgcttttttaaggaatgtagtaagaaaacaaaaactgatgaccaagagaatgtgtcagccgatgcaccgagtccag

SEQ ID NO: 31685 - DNA, 664 bp, Homo sapiens
  misc_feature (25)..(25): n is a, c, g, or t
aaactatagtgctaggtacgaggcntgggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaacaacaacaaaaaaaaaaaaccccgacgccacctaatccggggccgcggcgcaagggggtactgtgactggcgcccagggccttagctgttcccttgccccagcttccttggtcccacgtgggagatctcgcgggtcccctatagcgagccggataactccggaaaccgggtacctgca

SEQ ID NO: 31686 - DNA, 2406 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgctcaatggattactttggtttctccgagttccctgctaccccgtttattggaggc

SEQ ID NO: 31687 - DNA, 2480 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaaaaaaaaaaaaaaaaaaaaaaaaaaacgggggttttttgggggggagaaaaggaataaaaggtgggatatgttttgacacctttttagacagggggaaatggggccaaagggggtatattaggggtggaaaa

SEQ ID NO: 31688 - DNA, 2897 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtaagtggcttctctggggagagtcctctggggggcaggacctctcgtcagccctgccagccacctgccaggcccagggctgccctgctttatgacgaggccatgtgaagcactgcgatgcagtcccccaggcccctgccacaaccctcagccaccctatagctgttgaatgggataccattcaccagggctgccagggagttgaaggtttggcgggcttccatggtgtgattgccaccctaaacccttgaggaaggacaaaatgcacaaacagctttgtcctcgctggcgcagggctgttcatgtgtgcaccagcccccttcttcctgagtgccgtctgtgcctcacattccgtgtggtctatggggcagtggggcagctccctcaggcccctttgcaccaagagtggcagtctgggttctgctgggggcggtgacctcgatacccagcaaggcccagggctcctgctgcaccccaggcactgggcagagagcaccacaaaggcagcagcgtgtgtcctcgccaacagtccgcatcccaggtgctgcattcgtgcccttttgggggaaggtaagatagaagtttacagaatttaagcatctgtggggccaggcgtggtggctcacacctataatcacagtactttgggaggctgaggtaggaggatcacttgagtccaggaggctggggctgtagtgagctatgattgtgccactgcactccagcctgagagacagaacaagaccctgtctccaaaagaaaaagaccataagcatctggagcacctgcaagagcctgtgcatgggctcggcgtgactgagagtcctccgccttgcccgagcatcaggcaggccctcccaagacccctcaagatgctagaatgggactttctgcaaagtttaaacatctgtacaggatttagcttctttggtggcgaacttggattgtgatgccctcaggaagtctggtttcactctttctgtcactgtacgtcagcattcatgaaggacttgtattttctctgccttgtgaggtttggagacttgaaggaggacaaagtgacgcgtcatgatggagccagctcagacgggcacctggcacacatcttcagacatgcggccaaggagctgttcaacgaggatgtggaggaggggctgccctgagtggagtattaaagacacttaagaaa

SEQ ID NO: 31689 - DNA, 2499 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcagaaattagccaggcgtggtggtgcacacctgtgatcacagctactcgggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgctcaatggattactttggtttctccgagttccctgctaccccgtttattggaggc

SEQ ID NO: 31690 - DNA, 1678 bp, Homo sapiens
ggcggccgaggttggcggtccgggcccgcgctcgctcgcttcagggctcttcaaggcgcccccggcctcggcaccctgggccgctcggcgtggaggcggccggcgcggggtccctgcctctgcagggcgggttcggtcttcgcggttctccctgaacttgtccatctttcccacgcccgcgaaggcggaaacgcacggagaccgagcctctcgtgccgcgcaccacagtccgagaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaa

SEQ ID NO: 31691 - DNA, 2203 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaa

SEQ ID NO: 31692 - DNA, 1121 bp, Homo sapiens
  misc_feature (2)..(2): n is a, c, g, or t
anttcggcatgaggggacttcttccgcgttctgagggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaa

SEQ ID NO: 31693 - DNA, 1478 bp, Homo sapiens
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctgggatgctcccatttcccagtagcctccaggcctgcaggttcccatgacccacagccgggccaccgaggacgggttttgggtcc

SEQ ID NO: 31694 - DNA, 1377 bp, Homo sapiens
  misc_feature (1201)..(1201): n is a, c, g, or t
  misc_feature (1239)..(1239): n is a, c, g, or t
tgatttcataaaacgtttatgagtccaacacttccattatagccctgtatcaatgttttgcttagctgaaatcaatttcttggaggagtaagtgttatctttactttgtgagctgtaagggcccaaatcaatgtacttggtaaaactatccatagtgaacacacgcaaatgtcaaacggccatcatttagcatctgccctcgggcttccgggtccatcacgtggttactgacaggcaggccgcgcatgcgcgctgctactccgctgagcctacgtgacacgacgtgaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtgaagtgaggctgcgctccgccccgcgcgctccgattggctctggggcctggcccgccccttcccgacactgtcattggcctaggcaaagccgtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaaaaaaaaaaaaaaaaaaaaaaaaaacgttgtgtgggggggcttgggcccttggaaaaggtttttgaagaccntttggtgtggggcgggggggccccaatgttggtgttangtggaaccgggggccaaagaggtggttccctagagggaacaccggggacaagagacactagggctggtggatttctccacaatattaaaaaaagcccgggggggacacggatccgtttcggaacaaattcccaaatgg

SEQ ID NO: 31695 - DNA, 2846 bp, Homo sapiens
gtccctcacaccgagagttcctgcgcgtggggagttggagagtttgcgtggcgggaacgcggcggcagtgagagcgagcggcgccggcccttgcgtccggtgcggcgatgctgaccccggcgttcgacctcagccaggatccggacttcctgactatcgccatccgcgtgccctacgcccgggtctccgagttcgacgtctacttcgaggggtctgacttcaagttctacgccaagccatactttctcagattaacccttcctggaagaattgtagaaaatggaagtgagcaagggtcctatgatgcagataaaggaatttttaccattcgcctgcccaaagaaacccctggccagcattttgaggggctgaacatgttaactgctcttctggcaccaagaaaatccaggacagcaaaaccacttgtggaagaaataggtgcttctgagattcctgaggaagtagttgacgatgaagagtttgattgggaaattgagcagacaccctgtgaagaggtatcagaaagtgctttgaatccgcagtgccactatggatttggaaacttacgatcaggagtgttgcaacggttacaggatgaactgagtgatgttattgatattaaggatccagatttcacccctgcagctgaacgaagacagaagcgcctggccgctgagctggccaagtttgatcctgatcattatctagctgacttttttgaagatgaggcgattgaacagattttgaagtataatccttggtggactgacaaatattcaaaaatgatggcctttttggaaaagagtcaggaacaagaaaatcatgctacattagtgtctttttctgaagaagagaagtatcagctacgaaaatttgtcaataaatcttatctgctggacaagagagcctgtcgtcaagtgtgctacagtttgattgatatccttctggcatattgctatgaaacccgtgtcactgaaggagagaagaatgttgaatctgcatggaatatcaggaaactgagtccaacactatgctggtttgagacttggactaacgttcatgatatcatggtgtcttttggaagaagggtgttgtgttacccactctatcgccatttcaagctggtgatgaaggcctacagggacactataaagatattgcaactgggtaaaagtgcagttttaaagtgtctcctggatattcacaaaatttttcaggaaaatgacccagcgtacatactgaatgatctctacatctcagactactgtgtgtggattcagaaagtcaaatccaaaaagttggcagctcttgcagaagccttaaaggaagtctcccttacaaaggcccagctggggttagaactggaagaactagaagcagcagcactgcttgtccaggaggaagaaactgcattaaaagcagcccattcagtttctgggcagcagacactttgctccagctctgaggcaagtgattcggaggactcagacagcagcgtgtcatctggaaacgaagactcaggctcagattcagaacaagatgaactcaaagatagtccatctgagacagtcagttctttgcaaggtccctttcttgaagaaagcagtgcctttcttattgctgatggtggagtacgcagaaacacagccatccaggagtctgatgccagtcagggaaagccacttgcctcttcctggcctcttggagtgtctgggcctctgatagaggagcttggggaacaactgaagactacagttcaggtttctgaacccaagggcaccactgctgtaaaccgcagcaatattcaggagagagacggctgtcagacaccaaataattgactcttaggtggttttattcattgttgagaaatatggtagattgggtttcatttaccgaatgagaattcttcattttcactttgtaatttttcttagtatatagtcagcccactgtatttgtgtgttccacatctgtggattcaaccaactgcagatcaaaaatattgaagaaaaaatcgcatctgtaccaaacatgtacagacttttttcttgttattattctctaaataatacagtatgacaactatttccacagcatttacattgtattgggtaatataagtaatctagtgatgatttaaactgtgcaggaggatgtgggtaggttatatgcaaatactgcaccattttttatcaggggcttgagcatctgaggattttagtatcctcaggagtcctggaaccaaccccccacagatacggggacaactttatgacattgtttttcaaccaatgaatgtttataccttttgttttccttgccgcgactgtgaagataaagttcaaaagtatttttaccaaagtgtagctaatatttcaagctgaaaataatagttctactgcccgtgtctccagaatgtagagcccatcaatatttttattttaggaggtgtacttgacacccaataaactgcacgtatcaaaagtgtacaatgtgttggcgtatgtataccctgcgtaaaactatcaccacaactgaagtgaggaacggacccatcattcccaagtgcccttgtgccctgttattagtttgcatgtcctagaattctatgtaaattgaatcatacaatatgtatcccttttttggtcaggcatattttactcagtatagttattttgagattcatccatgtggtagcatgtgtcacgagtttttgtttttatgtttttcattgctgagtactgcttcattgaatagatttgttcattgacctctcgatggacacctgggttgtttccagtttggggctgttataaataaagctgttatgaacatttgtgtac

SEQ ID NO: 31696 - DNA, 617 bp, Homo sapiens
caaaaacatgaaatgtaaattatattaaaatgtcctttatgtgcatctgtattttgttaatgccatgtgttttagattcttatttgtaatctttaggactttatttaaaagctttcttgtgacatttgtgatgtattgatagtgtgagaaattacaaaaactaagattctgttttattgtaaagtatacaaaaagaatcttatttcatggttttatgtttctcttctacttggcttcacaatgatccgaacttgcagcttttaaatgagaaaagcttcctatttcattgtgtacttttgtttgtgtaacattttgtggaaatgactgcttattaaaatgacacttcacagacttggactaacgttcatgatatcatggtgtcttttggaagaagggtgttgtgttacccactctatcgccatttcaagctggtgatgaaggcctacagggacactataaagatattgcaactgggtaagatattactgtacttgcaaatttgggagggaaaaagttgtaagtttttagtctgtgaagatataataatgatttttgcttttttactgtatataaataagtaatgaaaaatgaatccaaccacttttaaagtatagaat

SEQ ID NO: 31697 - DNA, 140 bp, Homo sapiens
ttctccaaaacaaataaaggttgaatctgcatggaatatcaggaaactgagtccaacactatgctggtttgaggtaagatgtaaacaggaactgaaacacttacttcatatagaatcttactactccaaaaatgattcaa

SEQ ID NO: 31698 - DNA, 2830 bp, Homo sapiens
ctttttttttttgttattttgtatagtttgcgtggcgggaacgcggcggcagtgagagcgagcggcgccggcccttgcgtccggtgcggcgatgctgaccccggcgttcgacctcagccaggatccggacttcctgactatcgccatccgcgtgccctacgcccgggtctccgagttcgacgtctacttcgaggggtctgacttcaagttctacgccaagccatactttctcagattaacccttcctggaagaattgtagaaaatggaagtgagcaagggtcctatgatgcagataaaggaatttttaccattcgcctgcccaaagaaacccctggccagcattttgaggggctgaacatgttaactgctcttctggcaccaagaaaatccaggacagcaaaaccacttgtggaagaaataggtgcttctgagattcctgaggaagtagttgacgatgaagagtttgattgggaaattgagcagacaccctgtgaagaggtatcagaaagtgctttgaatccgcagtgccactatggatttggaaacttacgatcaggagtgttgcaacggttacaggatgaactgagtgatgttattgatattaaggatccagatttcacccctgcagctgaacgaagacagaagcgcctggccgctgagctggccaagtttgatcctgatcattatctagctgacttttttgaagatgaggcgattgaacagattttgaagtataatccttggtggactgacaaatattcaaaaatgatggcctttttggaaaagagtcaggaacaagaaaatcatgctacattagtgtctttttctgaagaagagaagtatcagctacgaaaatttgtcaataaatcttatctgctggacaagagagcctgtcgtcaagtgtgctacagtttgattgatatccttctggcatattgctatgaaacccgtgtcactgaaggagagaagaatgttgaatctgcatggaatatcaggaaactgagtccaacactatgctggtttgagacttggactaacgttcatgatatcatggtgtcttttggaagaagggtgttgtgttacccactctatcgccatttcaagctggtgatgaaggcctacagggacactataaagatattgcaactgggtaaaagtgcagttttaaagtgtctcctggatattcacaaaatttttcaggaaaatgacccagcgtacatactgaatgatctctacatctcagactactgtgtgtggattcagaaagtcaaatccaaaaagttggcagctcttgcagaagccttaaaggaagtctcccttacaaaggcccagctggggttagaactggaagaactagaagcagcagcactgcttgtccaggaggaagaaactgcattaaaagcagcccattcagtttctgggcagcagacactttgctccagctctgaggcaagtgattcggaggactcagacagcagcgtgtcatctggaaacgaagactcaggctcagattcagaacaagatgaactcaaagatagtccatctgagacagtcagttctttgcaaggtccctttcttgaagaaagcagtgcctttcttattgctgatggtggagtacgcagaaacacagccatccaggagtctgatgccagtcagggaaagccacttgcctcttcctggcctcttggagtgtctgggcctctgatagaggagcttggggaacaactgaagactacagttcaggtttctgaacccaagggcaccactgctgtaaaccgcagcaatattcaggagagagacggctgtcagacaccaaataattgactcttaggtggttttattcattgttgagaaatatggtagattgggtttcatttaccgaatgagaattcttcattttcactttgtaatttttcttagtatatagtcagcccactgtatttgtgtgttccacatctgtggattcaaccaactgcagatcaaaaatattgaagaaaaaatcgcatctgtaccaaacatgtacagacttttttcttgttattattctctaaataatacagtatgacaactatttccacagcatttacattgtattgggtaatataagtaatctagtgatgatttaaactgtgcaggaggatgtgggtaggttatatgcaaatactgcaccattttttatcaggggcttgagcatctgaggattttagtatcctcaggagtcctggaaccaaccccccacagatacggggacaactttatgacattgtttttcaaccaatgaatgtttataccttttgttttccttgccgcgactgtgaagataaagttcaaaagtatttttaccaaagtgtagctaatatttcaagctgaaaataatagttctactgcccgtgtctccagaatgtagagcccatcaatatttttattttaggaggtgtacttgacacccaataaactgcacgtatcaaaagtgtacaatgtgttggcgtatgtataccctgcgtaaaactatcaccacaactgaagtgaggaacggacccatcattcccaagtgcccttgtgccctgttattagtttgcatgtcctagaattctatgtaaattgaatcatacaatatgtatcccttttttggtcaggcatattttactcagtatagttattttgagattcatccatgtggtagcatgtgtcacgagtttttgtttttatgtttttcattgctgagtactgcttcattgaatagatttgttcattgacctctcgatggacacctgggttgtttccagtttggggctgttataaataaagctgttatgaacatttgtgtac

SEQ ID NO: 31699 - DNA, 1310 bp, Homo sapiens
gtccctcacaccgagagttcctgcgcgtggggagttggagagtttgcgtggcgggaacgcggcggcagtgagagcgagcggcgccggcccttgcgtccggtgcggcgatgctgaccccggcgttcgacctcagccaggatccggacttcctgactatcgccatccgcgtgccctacgcccgggtctccgagttcgacgtctacttcgaggggtctgacttcaagttctacgccaagccatactttctcagattaacccttcctggaagaattgtagaaaatggaagtgagcaagggtcctatgatgcagataaaggaatttttaccattcgcctgcccaaagaaacccctggccagcattttgaggggctgaacatgttaactgctcttctggcaccaagaaaatccaggacagcaaaaccacttgtggaagaaataggtgcttctgagattcctgaggaagtagttgacgatgaagagtttgattgggaaattgagcagacaccctgtgaagaggtatcagaaagtgctttgaatccgcagtgccactatggatttggaaacttacgatcaggagtgttgcaacggttacaggatgaactgagtgatgttattgatattaaggatccagatttcacccctgcagctgaacgaagacagaagcgcctggccgctgagctggccaagtttgatcctgatcattatctagctgacttttttgaagatgaggcgattgaacagattttgaagtataatccttggtggactgacaaatattcaaaaatgatggcctttttggaaaagagtcaggaacaagaaaatcatgctacattagtgtctttttctgaagaagagaagtatcagctacgaaaatttgtcaataaatcttatctgctggacaagagagcctgtcgtcaagtgtgctacagtttgattgatatccttctggcatattgctatgaaacccgtgtcactgaaggagagaagaatgttgaatctgcatggaatatcaggaaactgagtccaacactatgctggtttgagacttggactaacgttcatgatatcatggtgtcttttggaagaagggtgttgtgttacccactctatcgccatttcaagctggtgatgaaggcctacagggacactataaagatattgcaactgggtaagatattactgtacttgcaaatttgggagggaaaaagttgtaagtttttagtctgtgaagatataataatgatttttgcttttttactgtatataaataagtaatgaaaaatgaatccaaccacttttaaagtatagaat

SEQ ID NO: 31700 - DNA, 691 bp, Homo sapiens
gtccctcacaccgagagttcctgcgcgtggggagttggagagtttgcgtggcgggaacgcggcggcagtgagagcgagcggcgccggcccttgcgtccggtgcggcgatgctgaccccggcgttcgacctcagccaggatccggacttcctgactatcgccatccgcgtgccctacgcccgggtctccgagttcgacgtctacttcgaggggtctgacttcaagttctacgccaagccatactttctcagattaacccttcctggaagaattgtagaaaatggaagtgagcaagggtcctatgatgcagataaaggaatttttaccattcgcctgcccaaagaaacccctggccagcattttgaggggctgaacatgttaactgctcttctggcaccaagaaaatccaggacagcaaaaccacttgtggaagaaataggtgcttctgagattcctgaggaagtagttgacgatgaagagtttgattgggaaattgagcagacaccctgtgaagaggtatcagaaagtgctttgaatccgcagtgccactatggatttggaaacttacgatcaggagtgttgcaacggttacaggatgaactgagtgatgttattgatattaaggatccagatttcacccctgcagctcagcggccaggcgcttctgtcttcgttcagctgcagtcgacgcg

SEQ ID NO: 31701 - DNA, 2153 bp, Homo sapiens
caaaaacatgaaatgtaaattatattaaaatgtcctttatgtgcatctgtattttgttaatgccatgtgttttagattcttatttgtaatctttaggactttatttaaaagctttcttgtgacatttgtgatgtattgatagtgtgagaaattacaaaaactaagattctgttttattgtaaagtatacaaaaagaatcttatttcatggttttatgtttctcttctacttggcttcacaatgatccgaacttgcagcttttaaatgagaaaagcttcctatttcattgtgtacttttgtttgtgtaacattttgtggaaatgactgcttattaaaatgacacttcacagacttggactaacgttcatgatatcatggtgtcttttggaagaagggtgttgtgttacccactctatcgccatttcaagctggtgatgaaggcctacagggacactataaagatattgcaactgggtaaaagtgcagttttaaagtgtctcctggatattcacaaaatttttcaggaaaatgacccagcgtacatactgaatgatctctacatctcagactactgtgtgtggattcagaaagtcaaatccaaaaagttggcagctcttgcagaagccttaaaggaagtctcccttacaaaggcccagctggggttagaactggaagaactagaagcagcagcactgcttgtccaggaggaagaaactgcattaaaagcagcccattcagtttctgggcagcagacactttgctccagctctgaggcaagtgattcggaggactcagacagcagcgtgtcatctggaaacgaagactcaggctcagattcagaacaagatgaactcaaagatagtccatctgagacagtcagttctttgcaaggtccctttcttgaagaaagcagtgcctttcttattgctgatggtggagtacgcagaaacacagccatccaggagtctgatgccagtcagggaaagccacttgcctcttcctggcctcttggagtgtctgggcctctgatagaggagcttggggaacaactgaagactacagttcaggtttctgaacccaagggcaccactgctgtaaaccgcagcaatattcaggagagagacggctgtcagacaccaaataattgactcttaggtggttttattcattgttgagaaatatggtagattgggtttcatttaccgaatgagaattcttcattttcactttgtaatttttcttagtatatagtcagcccactgtatttgtgtgttccacatctgtggattcaaccaactgcagatcaaaaatattgaagaaaaaatcgcatctgtaccaaacatgtacagacttttttcttgttattattctctaaataatacagtatgacaactatttccacagcatttacattgtattgggtaatataagtaatctagtgatgatttaaactgtgcaggaggatgtgggtaggttatatgcaaatactgcaccattttttatcaggggcttgagcatctgaggattttagtatcctcaggagtcctggaaccaaccccccacagatacggggacaactttatgacattgtttttcaaccaatgaatgtttataccttttgttttccttgccgcgactgtgaagataaagttcaaaagtatttttaccaaagtgtagctaatatttcaagctgaaaataatagttctactgcccgtgtctccagaatgtagagcccatcaatatttttattttaggaggtgtacttgacacccaataaactgcacgtatcaaaagtgtacaatgtgttggcgtatgtataccctgcgtaaaactatcaccacaactgaagtgaggaacggacccatcattcccaagtgcccttgtgccctgttattagtttgcatgtcctagaattctatgtaaattgaatcatacaatatgtatcccttttttggtcaggcatattttactcagtatagttattttgagattcatccatgtggtagcatgtgtcacgagtttttgtttttatgtttttcattgctgagtactgcttcattgaatagatttgttcattgacctctcgatggacacctgggttgtttccagtttggggctgttataaataaagctgttatgaacatttgtgtac

SEQ ID NO: 31702 - DNA, 465 bp, Homo sapiens
agtttgcgtggcgggaacgcggcggcagtgagagcgagcggcgccggcccttgcgtccggtgcggcgatgctgaccccggcgttcgacctcagccaggatccggacttcctgactatcgccatccgcgtgccctacgcccgggtctccgagttcgacgtctacttcgaggggtctgacttcaagttctacgccaagccatactttctcaggcgagttcggggtgcctggccgcaggaaaggcgcattcgttagatagctgctttagagggagaatgcaaggtcgagagagcagtgctcgattgcgcgaatgccttttcccgacgtttccgcagcttctcttggtgccagggaactgccctcttccaggggtgcgttttagatgctgcggaagcccttttccttcttgagctttcttaaatcccatatcaaaggattgcggaatcacttgaaaaagtgacgtttgg

SEQ ID NO: 31703 - DNA, 578 bp, Homo sapiens
gttgaatctgcatggaatatcaggaaactgagtccaacactatgctggtttgaggtatgatttccagttgcaattgtttagaatttgttgttcaggaagttatttttgttgtttttacatcatttggggtaattcaagcaattccttgaatttttaaaagtagaagctctattgtacaagtatgttttccatctttttaataaaattctgataatgaaccaggtagagtactttggaagctgggggagggaaacacactttggagagaggatggagacatggtttgttgggaaagaatgtgggggcagagtgagaggtgtgtttgtaagttggcatgtattggagcttgaaactcagagatggaagcaaacctaggtgataagtgactgtcagggtctatgctaagaacacacacacacacacgaaaaataatgttttttatatgattttttatatatatgtgtatatgtaaaaaaacttcacctattctcagtatgtctgtgaggtaagtattgcaggttttacaggtgaggatccttagatcatatagcttaaatctcttatcttaggtcctacaa

SEQ ID NO: 31704 - DNA, 5370 bp, Homo sapiens
  misc_feature (1099)..(1099): n is a, c, g, or t
  misc_feature (3242)..(3242): n is a, c, g, or t
cgccttgtgtgtgctggatcctgcgcgggtagatccccgagtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgcaatcaaagagaagtacacagactggacagaatttctcatacgtgacttgactggttcgaggacagcacccgccaacctcctggaaggtcctctgcgagggaaaggccctatagacctcattacagttggttccttaatagaacttcaggattcccagaacccttttcagtactggatagttagtgtgattgaaaatgttggaggaagattacgccttcgctatgtgggattggaggacactgaatcctatgaccagtggttgttttacttggattacagacttcgaccagttggttggtgtcaagagaataaatacagaatggacccaccttcagaaatctatcctttgaagatggcctctgaatggaaatgtactctggaaaaatcccttattgatgctgccaaatttcctcttccaatggaagtgtttaaggatcacgcagatttgcgaagccatttcttcacagttgggatgaagcttgagacagtgaatatgtgcgagcccttttacatctctcctgcgtcggtgactaaggtttttaacaatcacttttttcaagtgactattgangacctaagacctgaaccaagtaaactgtcaatgctgtgccatgcagattctttggggattttgccagtacagtggtgccttaaaaatggagtcagcctcactcctcccaaaggttactctggccaggacttcgactgggcagattatcacaagcagcatggggcgcaggaagcccctcccttctgcttccgaaatacatcattcagtcgaggtttcacaaagaacatgaaacttgaagctgtgaaccccaggaatccaggagaactgtgtgtggcctccgttgtgagtgtgaaggggcggctaatgtggcttcacctggaagggctgcagactcctgttccagaggtcattgttgatgtggaatccatggacatcttcccagtgggctggtgtgaagccaattcttatcctttgactgcaccacacaaaacagtctcacaaaagaagagaaagattgcagtcgtgcaaccagagaaacaattgccgcccacagtgcctgttaagaaaatacctcatgacctttgtttattccctcacctggacaccacaggaaccgtcaacgggaaatactgctgtcctcagctcttcatcaaccacaggtgtttctcaggcccttacctgaacaaaggaaggattgcagagctacctcagtcggtgggaccgggcaaatgcgtgctggttcttaaagaggttcttagcatgataatcaacgcagcctacaagcctggaagggtattaagagaattacagctggtagaagatccccactggaatttccaggaagagacgctgaaggccaaatacagaggcaaaacatacagggctgtggtcaaaatcgtacggacatctgaccaagtcgcaaatttctgccgccgagtctgtgccaagctagagtgctgtccaaatttgtttagtcctgtgctgatatctgaaaactgcccagagaactgctccattcataccaaaaccaaatacacctattactatggaaagagaaagaagatctccaagccccccatcggggaaagcaaccccgacagcggacaccccaaacccgccaggcggaggaagcgacggaaatccattttcgtgcagaagaaacggaggtcttctgccgtggacttcaccgcgggctcgggggaggaaagtgaagaggaggacgctgacgccatggacgatgacaccgccagtgaggagaccggctccgagctccgggatgaccagacggacacctcgtcggcggaggtgccctcggcccggccccggagggccgtcaccctgcggagcggctcagagcccgtgcgccggccacccccagagaggacacgaaggggccgcggggcgccggctgcctcctcagcagaggaaggggagaagtgcccgccgaccaagcccgaggggacagaggacacgaaacaggaggaggaggagagactggttctggagagcaacccgttggagtggacggtcaccgacgtggtgaggttcattaagctgacagactgtgcccccttggccaagatatttcaggagcaggatattgacggccaagcactcctgcttctgacccttccgacggtgcaggagtgcatggagctgaagctggggcctgccatcaagttatgccaccagatcgagagagtcaaagtggctttctacgcccagtacgccaactgagtctgccctcgggaggtggcccattattgctgggatgcggtgttggtaaaggtttccaggactgaaactttgattttccgggatatgttaaatggtacagccactaagtatcaccagaaaaccagaagcccaggatcttctgcctccgccagcctgtgagctgtttccatgttttcaaagcacagcagcagtcgcttctggggagtgccagttaaagtcatgcatcagaccctgccagacgtgggcctgcttcttggctcacccacgttttgcctttctcctgccccaaatcaggcagctcccttggagcagggtttcctcagatgaggactgcattctttgaaaacaaagaatgtcgccaaggaagaaacctcacgccatgctgtagtgtttcctgtaatcacacgagcacatttatatatgcagtttcccatggataggcgtgtgaccctggttgagtggcacntgcggtttcatcttggtggcaactcctttgcaatgcagctggcagcgacatccttataaaaacatgtgctaaagctctgtcctctgttagaggtgccttttaggaatacggggagtgaaggaaggccggcaggcatctccatgcaactagatggtttgtttgtttgtttgtttgtttgttgttcattttgttgtgttttttgagacagggtcttgctctgtcgcccaggttgtaatgcagtggcgcaatctcagctcactgcaacctctctctcccgggttcaagtgattctcctgcctcagcctcccaagtagctgggattacaggcacccaccaccatgcctggctaatttttgtatttttggtagagacagggtttcaccatgttggtcaggctagtcttgaactcccaacctcaagtgatctgcccgcctcggcctcccaacgtgctgggattacaggtgtgagccactacgccccggcccaactggatggtttttgattgaagcctagaacatctgtagagacaaactctacccagtcttttctagaccctcaactatctccagtgttgttgtttaatcgtagccggatcagggagtgagtcttttaggcaaatgttggattatatatcaaaggaaaagcttagtttcagagaggaggaagggaaagagatgtgagggaagcatttcatcaaccagctacgtcccccttagaaggatcactgcagcaggtcaccgagcaggagtccctctgagcgtcccttctgtctcgttctgccctagctggcagcatatgaaccaggcatgatgcagcaggagcagtgaatctggagtcagccacttggcaccctggtttcgctgagaacaaactctgagatcttgggtgacttctcatcactctggacctccattcctgtgaagtgacaggtgtggaccctgagggtgcggtggtgagcacactgtctcctgctggcattcaccccactcatgctggaaaggaagatccagatcgtacaaaaatgagaaaaagaaagaataagaagggtctggtcccagttctgactcggccattcttacagctctttctggctttgagtttgcttgtggaatttcctgggcagttgtgttaaatccgccaggtcacgtgcagacaaagctgtggctgcgagagttggctggcctcttggaccagaagccatctccatatcctcatgagcgattccatatctccactcagaccctgtggactacagtgttccgctgtggtggctgccaagatgccttcttaaacttatgcaaggaaaccaaaccctcccacagttcccaagcagacactggaagcagaggcttctcacccttcctgctttttcaccacaatcaccttgagctcgtcccttggactagagtctccacagttccagtaaaattctgcggtgggctgatgagctgcttgcatttctgtgacatttccagatatgattctcagtgggattttggaaactttgattgctcaagctcacccttcttaacattctgtaatggttacagatgagaatggaaaacacatattttatggatgaggcgttttggtctcccctgcagtcgatttctagaatcaagttttagagttcggctgatgcatctgcctggggacctcagatgggaggagtgtgtcagttgtaccccgacagaaatgtctctgggatctgtggctggcttgccccgggcatctctcctttaagctcaagttttgaactctctgcggttttccacccctgccttctcagccacatgcttttggccttaaacgctcagtcttgtggagttcaactctgtcaaacgattggaaagggcatccatttccagatctttggcattttccccgcgctgactctttgatgatccttcactgtggccttttcaagctcagctgttcctgttgtatttgagacgagggtgagggaatgtggtggccacaaaagaacagggacttgcagcacaaatgtcacttctgtctcccttttcaatggtagcacggaggaggaggtgctgcgttggagggaggggatcctccaggagcctctggagcccatctaggaagctagagtgtgtggcccgccaggagc

SEQ ID NO: 31705 - DNA, 761 bp, Homo sapiens
cgccttgtgtgtgctggatcctgcgcgggtagatccccgagtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgcaatcaaagagaagtacacagactggacagaatttctcatacgtgacttgactggttcgaggacagcacccgccaacctcctggaaggtgtatgtattgttgttatacatctaatgtatctctgaagcaccccagttacgtgagctcagacctgacagcacctttgcatatatccttcagcagatgcgtgctttctgcagacactgccatccaaatagcctccttcctcttttg

SEQ ID NO: 31706 - DNA, 525 bp, Homo sapiens
cttcatgctatctaagccatttaagtgactaaaatccttacagagacatttgtaattataaagaattagaaaaacttaatgtgtactctctgctatcaaatttccagttgattgtgaacatgtcttaagattatattaccaatttcccttaaaactacctggaactgaacgaaagcatcttattcccctttacccttcaacatgctttcacctaccttcttcagttgaatactaattataaaatgtaggatttaatttatgtatttctaataatttgattttgtatatacctacatacatatgtacatatatacatgtatgtagagagagaactttcatattctaatttttcccaatagttttttgaggctaattcccatgtcagtacagcctacatttattgtgtacatgtatgtttcaataatttctacttaactgcaataattaatataaatctgaggcataattaagtcaaatcctttaggtgtaacgcatttcctatttagtgcagtgaattttgttata

SEQ ID NO: 31707 - DNA, 642 bp, Homo sapiens
atttcggaacgaggtgaaaatgtatatgaaattcaaattttgttgtccataaatacattttattgaaacacagccacacatcactaacatattgtttatgactgtgtttgtgctacaatggcaacagaaactgtacagcctgcaaagctgaaaatattcacaatgtggctatttagaaaaaaagtttgctgaaccctgctccattatctacttttttgtccatattatttatacaataaccttactgaaaaacttgtccagagctgagaaatcagcatagatgtcttcccagaaaagctctctctggaaacctctcccagtgacatccattgtatcatccagctttacttattttgcaatttagttatcaattttcctctctacttgtttattgcctaccttcttttatattatgtgatcctgagggtaggagataagttagctattgcattttcttttcctttacccttgataaatggtgagcttcacaaatcatttgctgaataaatgaatcaaggaagtgatgaagtaacaacattctaactgacggctttgtttctctgctaggctttcctggggtttgatgtatgctggcttcatccttatcatggccactttaatggctcttattgtaaaatctgc

SEQ ID NO: 31708 - DNA, 475 bp, Homo sapiens
aagcactgaggactctgattcatcatgtcaagcggtcaattagaatccgggaaagcctctctctggcctcaccttacttcctgtaccaggagagatgctcatcaatagtgagaaagagttgatgggattagagtctggaagtgacaacctctcctgaacctgaactcattgatttcttcgttttacaaaacagtgttcttgaaaaaaataaacaaaaaaaggaaataatacaactaagaactccaaggtctaaattttaaccagctgtatctcataacaacagaagctgcaatggccaacatacgtcatttataaaacgccaacttatgtggatggggattgggatttattggcctaatgcaaagagcatataaaaaatgagtagggaaaagactactgtttgtgtatatatgtaattattacatatattcttaaatgatatttaataaataatcaaatgattaaataatatata

SEQ ID NO: 31709 - DNA, 720 bp, Homo sapiens
gccaggctggtctcgaattcctgacctcaagtgatcctcccaccttggccatctaaagtgctagggttacaggcatgagacaccgtgcccagccaagactatattcttgacattaatgtttcatgtcttgttttcggacctaacttacccccaaaattttcagtaatgcttaaattaacatgtttattctcacttcagctctgttgccaagaagaaccttcagttcatctctaaaagcatttattggatgcttactatatgctgaatgctagagttatgaaaatgaatgacctagtccccacctatcaggaacttaaaaactagtggtgagggattttaaaccaaaacttcaatatagtatagtaaaatgtattatagaggtatgccttgcagttatggaaatcaaggaagagcaccttacctaagttgagggttcaaagaaggcctcttagaagggatgttccctgaacccaagtcttacacagttagcaagaaaaaattgggaagggtatataaacaaaagcagataggtgtgatatttacatggaagtataagcaattctgtgatagagtacaaagtataaaatgaagattggcagatgacattggagatagctatgtgattattatccttataatccatgttaaggaattttactttatcttctaggtcaggagaccatatccagtctactttctaatttgtaaattaaaaaaaaa

SEQ ID NO: 31710 - DNA, 259 bp, Homo sapiens
ttctccatgttgcccaggctggtcttgaactcctgggctccggcaattctcccatctcaacctcccaaagtgctggggattaccagtgtgagccgctgacccagccctctacaaaatacatatttttttaattaggtggtcgcagctgctcacaaggctgaggtgggaggatcagttgagcccagaacttcaaggctacagtcagttatgatcacaccactgcactccagtctggacaacagagtgagacctggtccct

SEQ ID NO: 31711 - DNA, 410 bp, Homo sapiens
caggctgcaaagctggagtgcagtggcctgacctctcagctcactgcaacctctgtatcccctcagcctcctgagtagctaggactacagcacgagccactgccccccgctaatttttttttctttttttatagagacaaggtctcactatgttgcgtaggctggtctcaaactcctgggcgcaagcaattcacccactttgggaggccgaggtgtgcggatcgcttgagctcaggtgtttcagaccagcttgggcaacatggcgaaacgctgtctccacaaaaaaatataaaaaattaactgggcatagtggcacgggtgcggtggggtaagggggggtcgaagctgtagtgagccttgattgtgccactgcattctagcctgggcgacaaagtgagaccctgtattaa

SEQ ID NO: 31712 - DNA, 408 bp, Homo sapiens
aatctcattctcttagctgggcgtgcaacagaccaacagataactcatcctaaacagagaaatgagaaagagtctgtgggtgggcctctgagggccacagaaaaccagacaccccacatgtcggtggattggagaggggcaggccactgccctctccaggaccaagccgggttcttggtccccaccctccctgcactccgcatctcctccccagcagccattctcccctttcccttgtgaacaaaagcctagttttgtgtgggcagcaatatagggtaaataaaaccacctgattctccagccttccttgctgttaggagggactgttggcctagtcctggcccacgagatgagggtggggtctgtggggcagggcttcttgagagccgtcgtttttctaataaaatg

SEQ ID NO: 31713 - DNA, 156 bp, Homo sapiens
agctccttataaaccaagactgaatcttgtgcctgtcattgtgagcgctattctgtaaagggatttttttttctggcataccaaatccagagccataattggacaagtttaattggagtcatttctattcaatacatggatggcaaagtgggtttt

SEQ ID NO: 31714 - DNA, 340 bp, Homo sapiens
ctcaggcatcagatcaccaatgacaaactcaaagtgccagagagcatctacctcaacctgtgcccggcccaacaaagtgaaaagagaaatcagaggttcagaaactcaaggtcaaatagaaagtctctgtaacaaagactagaatctactcttgctattagtttgggattcactcctctgctttctactttctggttatagtataggcattgcaactatggtttacagctctgggtcaaatcaacgaaggttcaagttgtgatgctaatttgtgaccttgaacaagttttttaacctggtatgcacattggtttcctcattagcaaaatcgggatagtaa

SEQ ID NO: 31715 - DNA, 341 bp, Homo sapiens
tccattctttaggcctcttgtaatcatcttttactgtctatcctttggcctcatgctctatcaccaagtctgtcctatttgtttcacatgtttctcatttaactctttcatctgcatttccatcctaattcaggtcttgattccccaggtgtggcttactattcaagcctcctagctgctcctcctcctcctcctcctcctcttcctccccctcctcctcccacccccttttttttgagacagggcctggttctgtcacccaggctggagtgcagtggcatgatggagtgcagtggcatgatcatggcacactgcggcctccacctcctgggctcaagtga

SEQ ID NO: 31716 - DNA, 346 bp, Homo sapiens
gcaccaggtgaactggctgcgtaatccatgtgtctggttgttcattgaatttaagaaacacagtggaggctgggtgcagtggctgacacctataatcccagcaccttgggaggccaaggtgggtggatcacctgaggtcaggagttcaagaccagcctggccaaagtggcaaaaccccgtcgctactaaaaacagaaattagctgggtttggtggcacgtgcctgcagttccagctacttgggaggctgaggcaggagaattgcttgaacctgggaggtggaggttgcagtgagctgagatcacgccactgcaccccagcctggcgacagtgagactccgtctcaa

SEQ ID NO: 31717 - DNA, 503 bp, Homo sapiens
gttacgcaattgccggctctgtcatcttctacagggatgtgaccttacggaaaagtaaggaatctgaagcgtggcagatcactttgaagcttgcccagtttttgcatgttatcatgtaatagtgctaaaactttttgtcctccagctaggcaacataggtatgtaatttagactttgggaatactgtagagctgtgataaaccctgctttaagctacattctgggatcgtaacatgtaatttagaagtcaaaatccacttagaagaaaagaatttttaaagcacggtaaatcagaaccatttttgtgattaatttttattgatctttttaaatttttcataattttatgttctggttctcataagaacaaatacaaataattttaaaccttaaagatgtttaaatctgttaaatattttatttatgtaggatttttattccttaaagtcacatgtggagttttttatttttaacaaggtattagtactattaggtaatactaa

SEQ ID NO: 31718 - DNA, 499 bp, Homo sapiens
agaccacttagaaacaccgcaatcacttctactactcagcagatactgagcagtaggtttcgtgacagagcacctgtcttttgtccagtctgtttactatacattgcgtgctctgggcagtccttatcttcgtgttcaggaacaaagtacacacacccctttccgaaacgaagggcccagggactccgagaagggtgggagccctcacggccaggccacacaatggggagcctctttaccctagtcatcacccacccttgcaggccccactttgccagggtgcgacttctcgggccccttcgcccctcccctgcagcccccaggagcgcagccacagcccggccgggcgccctccctgtctctctctctctttctctctcgagctttcctcctccttcaccgggagccggaaaacccggagcgaaccagcccagcacggcagcgcatgctcagtagcgagcaggttcagttcgctagtaggaagctccagcgctacacc

SEQ ID NO: 31719 - DNA, 1028 bp, Homo sapiens
gagatctttcctcttcacatgtgctcctcctctgatgtgccccaccccagtgcaagggcagcaccttccacccatcacccaagccagagacacagttggcacaatggacttctccctgcctttactccccatctccaagctgtcttcccacacagctcagattcattccaaatggcctatcttttatggaccagtcactcctcacctggtcggtgtagcacgcacggaatttcttggactttggctccgtcttagagcaacccacctctcccctctgcactgctgctggagtcagcttcctagaaccctgatgctatcctctcactttccctagccaggactccctttcccaagccagcctctgccttcctctgccttccttcacgtaggaaatctctatgtgatttccagagattcctggagacaggagaaggtgtgccctgattctgtgggaagcacggaaggaactggtgcaggctgtgtgtgtcacagtgttgggtgacaacgggagcagctcaccagtcttgttctgagcaagaggctgaagattgagggatacattccccatctgtttacctgccagctgtgccttggttcaaggcaaattttatgtagaatataaaatgctattacagaaaaagtgtcataagactttattcaagattttcaatgtcatagtttttggtttcataatgacaaatatattttaaatgttttttaatcaagtgagtcacataataacatatcattaatgtgttatatattttgttatcacatataattacataaacaaattggtcaattgaacaaaataaagaatccagaaatagatttacacatatttggtaaattgatttttgacaaaggtgcgaaggcagttcaatagcaaaataagagtcttttttaacaaatgataccagaataattggatagacatgtgcaaaaaaaattttttttgagaaggagtttagctcttgttgcccaggctgaagttcagtggcgcgattttggctcacggaaacctccgc

SEQ ID NO: 31720 - DNA, 314 bp, Homo sapiens
ataaagtgccgctaaaatcttggtaaaaacaaggactggaccaacaacagccagccaaaaagtggacaggtcattatgatgttttattaactactcattcatctgttaagctggctggagtcaaaccacgcatacatcacatttcggtaaaaatcgcccctccccaacctgacacagcagacaatcaacctggttggacttgtgagccaactggagaactgaagctactgcttaagaaaaatctttttgtactataggattaaatttctgttattctttatcataatgagtaaacttttttgacatctgctaaa

SEQ ID NO: 31721 - DNA, 760 bp, Homo sapiens
tacacatgtggtggctactagttcctggaatagcaaagcaattgctacctccatgccttttcagttgctttagataagacctgttttgcacctgagaaaacagaaagatcagagcagcttttttgtgtgttttgtttacacagtgttgttgtattttcatttgctctagacttcaaggcagatgcaaaagaaaatgaaaaacaacttaggttcagtagagtggtcaagtgatcctactcctttggggaaggatatgccacagactcctggaaggctggagatgttggggctcagaaagcaataccccaaaatagggtgctttgacatgctgaagtgaggcagaagcctcagggtctctctgaccttcctccacacccctcatttctctgtctctcccaaagcacagaatcaagttgttctctggagttccttctatctgccagcccccaaacttttaatgtggaagttacaagagggtaacttccaaagggtaacatccaaaaggttgcaaaataagggaatagaacaaaaaaagaggaagacagaaatgccaaagaaggaaacaatcacttctggtcactcccctgtgttttcattaactgaactcatatcgcgtaaagaaagcctgaattcagtcaacacacctggacagaattttgtcacaaaccattgtctgcccaacagactttgtcccaatccattgtatgttcttcaggcccatcaaattccctaaaaatcatctactacctccctaaaatca

SEQ ID NO: 31722 - DNA, 890 bp, Homo sapiens
caggcgggccatggcggatgtccccggggcacagcgagcggttcctggtgacggcccagagccccgggaccccctggactgttgggcctgcgctgttcttgtaacagcccagaatctgctggtggctgccttcaatcttctcctgctggtgctggtgctagggaccatcttgctacccgctgtcaccatgctgggcttcggcttcctctgccactctcagttcctgcgctcccaggcacccccttgcaccgcgcacctgcgggaccccggtttcacggccctactggtcaccggattcctgctcctcgtgccgctgctcgtgcttgctctggccagctaccgccgcctctgcctgcgcctccgcctagccgattgcctcgtgccctacagccgagccctttatcggcgtcggcgcgccccgcagccgcggcaaatccgggcctcaccagggtcccaggccgttcccacatcaggaaaggtctgggtctaatgaccctcgagtcaagaacaaccctgacggctgccctccctcttattcggcccaaggacttgaagcccggcatcttccgacctgccctgcccccacccctgcctgagcggagtcctagcatccccttgggagcagcagcgtcagtggacccagtgctgagaaaagcccccacatcccggaaaacccactttcctttcacgacccacatctcaatcctgaacatctaggctggaacctgcacacctccccctcagctccgtcgtgaatgggacaacaatctcgtgccctcgttttatggtgcagcttctctagtatttctggggctggggggcggggctggaggggaaggagtgtccacgcatcaataaagatttaacgaactgaacgcgctctgcgaaca

SEQ ID NO: 31723 - DNA, 564 bp, Homo sapiens
caggcgggccatggcggatgtccccggggcacagcgagcggttcctggtgacggcccagagccccgggaccccctggactgttgggcctgcgctgttcttgtaacagcccagaatctgctggtggctgccttcaatcttctcctgctggtgctggtgctagggaccatcttgctacccgctgtcaccatgctgggcttcggcttcctctgccactctcaggacttgaagcccggcatcttccgacctgccctgcccccacccctgcctgagcggagtcctagcatccccttgggagcagcagcgtcagtggacccagtgctgagaaaagcccccacatcccggaaaacccactttcctttcacgacccacatctcaatcctgaacatctaggctggaacctgcacacctccccctcagctccgtcgtgaatgggacaacaatctcgtgccctcgttttatggtgcagcttctctagtatttctggggctggggggcggggctggaggggaaggagtgtccacgcatcaataaagatttaacgaactgaacgcgctctgcgaaca

SEQ ID NO: 31724 - DNA, 410 bp, Homo sapiens
ctaaactcccttctgctggactgggtggctatatcacatctgctggtctggatggctatatcagtcagtgttctccagaaaaacaggactaatgattctctctctgtgtaatttaaggaattggcttactcaatcgtagagtctggctaggcaagtctgaaatctgcagggcaggctggtggaccggaaactcaggctggagctacttctgcagtccgctggcagaattttctgcttcttcctcaaggaaacctcagtttctgctcttaacaccttcgactgactcattaggcccacctaaattattgagggtaatctacttcatttaaaatgcattgattgtagatgttaaccacatccacaaaataccttcacagcaacacctagcatttgattaaacagcctgacac

SEQ ID NO: 31725 - DNA, 376 bp, Homo sapiens
ccccaccccccccaaccacgcacacacccaggcctgtgtgaatatgaaccatcttggaagataaacagagagtgacaagctggggcccctcagccccctccctcagccagccggtcccttccccctgaaagccgaccccctcccccaagcccatctctcttcctgccaagcggctgcctacaggagaggtctgggggcagggcagcgagcccaccagccgcagagcccggccctctgggagcggcccctccaggcccgcccctgcccctgccgtggccagtcttcccgcggggaggaggcaagaggagaggagaccgcagacggtgcaggaccgcagtcctggaaatcgcaaaatcctctagcgagggggcggccg

SEQ ID NO: 31726 - DNA, 2829 bp, Homo sapiens
  misc_feature (2618)..(2618): n is a, c, g, or t
ggagtgtcagtgtgggtcacgtgaggggagcggagagggagggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggtgctgggcgtgcagacgggcgggcccgggggccggcgggcgggggagccgggccacagccccgccgactacctccgcttccaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcacaaaaaaaaaaaaaaaaaaaaagaaaaaaaaaaacaaagaaaaanaagacaaggaagacaaaagcaagacaagcacaaacagccaacaaagcaagacagaggggcgggccaccccaaacaaaacacgccaggggagcgaacccagagttccaccggccccaacgtagttggcaagaaagcaaggtcccgccaaacagaatgcgaaaaataaggacgacaacgaccgagaacaaaaaaaacctgagcggtcgcgaca

SEQ ID NO: 31727 - DNA, 2575 bp, Homo sapiens
ggagtgtcagtgtgggtcacgtgaggggagcggagagggagggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggtgctgggcgtgcagacgggcgggcccgggggccggcgggcgggggagccgggccacagccccgccgactacctccgcttccaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcaca

SEQ ID NO: 31728 - DNA, 2491 bp, Homo sapiens
ggagtgtcagtgtgggtcacgtgaggggagcggagagggagggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcaca

SEQ ID NO: 31729 - DNA, 2688 bp, Homo sapiens
  misc_feature (2477)..(2477): n is a, c, g, or t
tgctggccgctcgcccaccccactgggggccccaccgcgccccagccccccgtgggccccgcgccagccctgacccgggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggtgctgggcgtgcagacgggcgggcccgggggccggcgggcgggggagccgggccacagccccgccgactacctccgcttccaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcacaaaaaaaaaaaaaaaaaaaaagaaaaaaaaaaacaaagaaaaanaagacaaggaagacaaaagcaagacaagcacaaacagccaacaaagcaagacagaggggcgggccaccccaaacaaaacacgccaggggagcgaacccagagttccaccggccccaacgtagttggcaagaaagcaaggtcccgccaaacagaatgcgaaaaataaggacgacaacgaccgagaacaaaaaaaacctgagcggtcgcgaca

SEQ ID NO: 31730 - DNA, 2253 bp, Homo sapiens
  misc_feature (2042)..(2042): n is a, c, g, or t
cagctgcgaagtatgcatagtgttcttggtgggtctccttgcctggagggagaagaatggtgcctggctctgccctgctcccacccctttcttcgtgacatgccctgccccaacaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggtgctgggcgtgcagacgggcgggcccgggggccggcgggcgggggagccgggccacagccccgccgactacctccgcttccaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcacaaaaaaaaaaaaaaaaaaaaagaaaaaaaaaaacaaagaaaaanaagacaaggaagacaaaagcaagacaagcacaaacagccaacaaagcaagacagaggggcgggccaccccaaacaaaacacgccaggggagcgaacccagagttccaccggccccaacgtagttggcaagaaagcaaggtcccgccaaacagaatgcgaaaaataaggacgacaacgaccgagaacaaaaaaaacctgagcggtcgcgaca

SEQ ID NO: 31731 - DNA, 2455 bp, Homo sapiens
ggagtgtcagtgtgggtcacgtgaggggagcggagagggagggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcaca

SEQ ID NO: 31732 - DNA, 2648 bp, Homo sapiens
  misc_feature (2437)..(2437): n is a, c, g, or t
cgccttccggtctcagcaggcccaggagggcctcctgggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggtgctgggcgtgcagacgggcgggcccgggggccggcgggcgggggagccgggccacagccccgccgactacctccgcttccaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcacaaaaaaaaaaaaaaaaaaaaagaaaaaaaaaaacaaagaaaaanaagacaaggaagacaaaagcaagacaagcacaaacagccaacaaagcaagacagaggggcgggccaccccaaacaaaacacgccaggggagcgaacccagagttccaccggccccaacgtagttggcaagaaagcaaggtcccgccaaacagaatgcgaaaaataaggacgacaacgaccgagaacaaaaaaaacctgagcggtcgcgaca

SEQ ID NO: 31733 - DNA, 2404 bp, Homo sapiens
ggagtgtcagtgtgggtcacgtgaggggagcggagagggagggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggtgctgggcgtgcagacgggcgggcccgggggccggcgggcgggggagccgggccacagccccgccgactacctccgcttccaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccatactctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcaca

SEQ ID NO: 31734 - DNA, 4635 bp, Homo sapiens
gatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagactggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagattggatgacattttaaggaaaagattgaaggactcaagtgaaatacctggtgctctgtggcatatttatgctgggaaagatgttgacaagataagggaatttcttcaaaagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacatcttgtagagtcatttcatttaacacaggaactgagacttttgaaggaagaaatcaattatgatgataaactacaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcacagcagtcatgtcataatcagaaaattactgccaaataattgtaaaatttgtaaagtataaagtatataaagtagatactaaatacagacacttcaatattttgttgaagctattgactgtacaattaaacattttcaaaaggtgtaatttatttaaaattgtctcattttggtaaaatttatgtgaacttttaaagctaaatattaaacttaatatgctatgtaaatatatacatatatacatttaatgatgtatttttttaaaacattggcttgcttttgttaaagtgcaagtgttacatatggctttgtacattaaagttgaaaggggttttacattttccattaaaaggactttatcaaaaattgcacaaattccagag

SEQ ID NO: 31735 - DNA, 1315 bp, Homo sapiens
  misc_feature (10)..(10): n is a, c, g, or t
caataaaatngaaatttaactgaacaggatttaccatttccttacttaaatggagtgtctattttaattcatatttcagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacatcttgtagagtcatttcatttaacacaggaactgagacttttgaaggaagaaatcaattatgatgataaactacaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcacagcagtcatgtcataatcagaaaattactgccaaataattgtaaaatttgtaaagtataaagtatataaagtagatactaaatacagacacttcaatattttgttgaagctattgactgtacaattaaacattttcaaaaggtgtaatttatttaaaattgtctcattttggtaaaatttatgtgaacttttaaagctaaatattaaacttaatatgctatgtaaatatatacatatatacatttaatgatgtatttttttaaaacattggcttgcttttgttaaagtgcaagtgttacatatggctttgtacattaaagttgaaaggggttttacattttccattaaaaggactttatcaaaaattgcacaaattccagag

SEQ ID NO: 31736 - DNA, 1388 bp, Homo sapiens
gtatttcacggtttttcttttggggataggttcagaattttcacagctgtattcaggtaactgaagattttgtgtctccagaacatcttgtagagtcatttcatttaacacaggaactgagacttttgaaggaagaaatcaattatgatgataaactacaggtaagagttgggtgttctaggtcctgttcttcaggctttttatattcagaaatatgatacatgtataacagcttaggcagtcattgcctagttggtcacattagggtgacaaccaaagattaacaccaacatgtatttaattgtatgatttatagtgtcccttttggcttaacactttcaaacatttttcttatatttggctttcctagttccctattatttttttaaatctggaagttgtcattttttaattaatttctgtcgaactgaagtgattagaaatatcaacatctctttcaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcacagcagtcatgtcataatcagaaaattactgccaaataattgtaaaatttgtaaagtataaagtatataaagtagatactaaatacagacacttcaatattttgttgaagctattgactgtacaattaaacattttcaaaaggtgtaatttatttaaaattgtctcattttggtaaaatttatgtgaacttttaaagctaaatattaaacttaatatgctatgtaaatatatacatatatacatttaatgatgtatttttttaaaacattggcttgcttttgttaaagtgcaagtgttacatatggctttgtacattaaagttgaaaggggttttacattttccattaaaaggactttatcaaaaattgcacaaattccagag

SEQ ID NO: 31737 - DNA, 4663 bp, Homo sapiens
gatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagactggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagattggatgacattttaaggaaaagattgaaggactcaagtgaaatacctggtgctctgtggcatatttatgctgggaaagatgttgacaagataagggaatttcttcaaaagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacatcttgtagagtcatttcatttaacacaggaactgagacttttgaaggaagaaatcaattatgatgataaactacagtgattagaaatatcaacatctctttcaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcacagcagtcatgtcataatcagaaaattactgccaaataattgtaaaatttgtaaagtataaagtatataaagtagatactaaatacagacacttcaatattttgttgaagctattgactgtacaattaaacattttcaaaaggtgtaatttatttaaaattgtctcattttggtaaaatttatgtgaacttttaaagctaaatattaaacttaatatgctatgtaaatatatacatatatacatttaatgatgtatttttttaaaacattggcttgcttttgttaaagtgcaagtgttacatatggctttgtacattaaagttgaaaggggttttacattttccattaaaaggactttatcaaaaattgcacaaattccagag

SEQ ID NO: 31738 - DNA, 450 bp, Homo sapiens
atggtctggagaagataactttaagtgatcaagtagttgctgcaataaacattattgtgggaataaagaataaaggcttttgcattgatttgatttctactaagtgtactggaggatacggaagaaggaaaagatgagttcatggctttaaatcctaatccacaacctgggtagggatccaggaaacttctataattgtcctggaaaacacagacacagagaaatatctcctgtagctgcagggttaaaatttctgaaaaccaagcttgaagtctgatcctgtgggcggctgaacttacaaatgcagcattgtggatgcatctcaaaaacatgatggagagcaaaacttccagatacaaaaaggatatacggtctaattgcatttttgaaaagatgaaaaaattaaaactaaccttacaagttttgatggcataactattaaaaaaataa

SEQ ID NO: 31739 - DNA, 264 bp, Homo sapiens
tacccctcatggcacccagtctcattacatagttgtgtccaagaaaaccactgagacctggacacaacctctcttaagagccagtcttgcctcttggctatttaaagtacactgagatatggaaatcttgactgatgaatgcttgattgaattggagaggaattattggattcttgcatggaggacaaggtggccagccacactaggggtagcacaagatgtgttaggaacgtaacttacccatttgttgatttaattgacttt

SEQ ID NO: 31740 - DNA, 1528 bp, Homo sapiens
gctgggctgggctcggcacggggcggggcggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggc

SEQ ID NO: 31741 - DNA, 1270 bp, Homo sapiens
gctgggctgggctcggcacggggcggggcggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagagatggagtctcaccatcttgcccaggctggtctggaactcatggcctcagatctcttcaaagggccttgggttcttgaccggcaacttgtgggccaaaaacgttgacccgtgcagacccttgaaggctgttccatgagtgacattggagcgggttgctgcattgccaaggccgcagtggggtccgagtggattggaagctcccctttggccttcttgccagcttggctcagggtgcccggtgtattctatttacccgttgtgctgaactgctggaatctggcggctgcccagagtcctccattcgaaaaaagcgggccgactcggtgattaagaccttcgggtgttgcccccttgaccatggtgcttccacggtcgtgtgggacacaccccggaaaagggagagccacaaagagagcgtgacacgaacattggggggaggatgaaaatacgtgtgtcatgaatcacacacgcctcgtgagttgactcacaagtgtcacgtactccacaactatgcctctgcacgcacgatcatcaat

SEQ ID NO: 31742 - DNA, 1213 bp, Homo sapiens
atgaagccgagcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggc

SEQ ID NO: 31743 - DNA, 1218 bp, Homo sapiens
gaagtaaggatatcgtcgaccagcgcccatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggc

SEQ ID NO: 31744 - DNA, 1374 bp, Homo sapiens
agaggagttggagcccgctctgcgcgctgcgggacggggcacggcggagcagggttgggtccgcctcgagcggggagggtgatgctgcaccacaggggcggggctggaggtaaagcgcggagcggagagggaccaggctcggcactgatttgtgttcagggctagcccagaggggcggggccagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggc

SEQ ID NO: 31745 - DNA, 1482 bp, Homo sapiens
gctgggctgggctcggcacggggcggggcggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggc

SEQ ID NO: 31746 - DNA, 936 bp, Homo sapiens
cagcatctcaggtgctcagtagctaggtcagctgggagctgtcatggcacaaggcatttgcgtctggcggaggctgtttggttggtggctccaggccctatattcagcctccagagctttggcagaagtgctgtgcttcatttttcactagggaaaatgcccagccggggtacctcgctgaagtcggcttgcacaccacagaaaaggctccactcccgcctgcatctgtcctcccttccctctccccagggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggc

SEQ ID NO: 31747 - DNA, 702 bp, Homo sapiens
attagaggatccctctgggctctatcagggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggc

SEQ ID NO: 31748 - DNA, 354 bp, Homo sapiens
gtgatccttgttccctagcctcccaaagtgctggcattacaggcacgatccactgtgcccggtccatccttagttttcaacatagatatcaaaaaagcattcagcatgaaccagtcgaaagatgaccttactctgagaaagaaaggctcacgttggaagcctgtactccttagttagaaccaagacttgatttttctggtgacaggaaattctttttattgcagatctctcaaaggccttggttctgacagaaattggccccaaacgtgaccctgcgaccctgaagctgttcctgagtaacatggagcggctgctgcatgccaaggcgcatgggtaggaggttcagttcgggga

SEQ ID NO: 31749 - DNA, 311 bp, Homo sapiens
agtgtaggaaggtccttctgagcctgcggggagccgcacagcacacaggctcccgagagctgccgctcttgttccagagagtaaacctttctattttcctttgcagattcccgactgtggcggttagcattggatttgctgttcgacaagaggtgcgggtgtggcccaggtccccagggcccctccctgggctccctctggccatccttcctttctggcttcagcctctgtgcgcctggtttgctgtttgccctgtgccttaatcatgactggcaaatccaagcctgtgggtttcaaatccgagaaaataa

SEQ ID NO: 31750 - DNA, 404 bp, Homo sapiens
ttagatctagtcttttctttgatcctgagaatgcctttggaaggtgtaaacagcggccagctccacagggaccagcctgcagaaggttcattgcagaagaggccgcggcttctggggccaagtgtgtgctcacccacagcccgacgtggatcatcgaccccatcgacggcacctgcaattttgtgcacagcggggtcgcagtggctcgcagtgtggggcggctgctgggtgccgaggctgcgtggggtccgagtgatcggaaggtccacaattggtgactctggcgagctggccgtcaggggccgcggggtgcctatgtagccacgttttgtggcctgtgggctgcggtgggatctgggctggctgccggcaagtcagtctactcatgcagaaggcacgggggc

SEQ ID NO: 31751 - DNA, 1490 bp, Homo sapiens
cagtgtgtttggactgggcgtgtgtgactaagtgcacatgatgcttgcgtggatgcatgtgcacatgggatgttgtttgacgccttggctggctgtggactgtgctgtggatcctggtggtgagcctggaagtccctgccgattgtgtggtggcttggagtgttggacgtggtgccctgtgctgattggccggcgagtagagagccagagctggctgagtgaccatgtgcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggc

SEQ ID NO: 31752 - DNA, 1563 bp, Homo sapiens
gctgggctgggctcggcacggggcggggcggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggcctgtgtgtatctgtttcctctataagcatgtcgcc

SEQ ID NO: 31753 - DNA, 1548 bp, Homo sapiens
gctgggctgggctcggcacggggcggggcggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccataacggacttcagagcatacaatgccgccccgcggttcggctgtgtgtgtgtggggggg

SEQ ID NO: 31754 - DNA, 1393 bp, Homo sapiens
gctgggctgggctcggcacggggcggggcggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggcctgtgtgtatctgtttcctctataagcatgtcgcc

SEQ ID NO: 31755 - DNA, 541 bp, Homo sapiens
tgaagttcaagaacaggcaaaaaagtccagacaatgtgttcccgttggtatagtatatatgtatactatatacgtatatcatgtatatgctgtatacgtatatctcgtatatgctgtatacgtatatctcgtatatgctgtatacgtatatcgtatatgctgtatacgtatatctcgtatatgctgtatatgtatattgtatatactgtatacatgtatatgctgtatatgtatatactgtatatgtatagtatatatatgcagggtatagtgatggaggagatgtaaaaggggcttctagggactggttatgttctgtttgttgaactgaatgctgtttacgtggttgggttcgttaagaaaattctttgcatagtgtgtggtgacgcacacctgtaatcccagcactcagtgaggcagaggcaggagggtcacttgagcccaggaattcgagaccagcctgggcaacatagtgaggcccccatctccacaaaaaggaaaaaaagggtaacgtgacattttttagccagcgctggatcca

SEQ ID NO: 31756 - DNA, 404 bp, Homo sapiens
acatttgagacatatacataaaataacaatgcctcttccttctttaagctatttcatatgactttatatgtaatattaaatcttggctatctgaggaacatgtctaaagattataggtgattttacgtgtaaagatattcattgaatattaactacatgctagcacaaaggcaatactttttatatttgcccattgatgggtgtgtgtgtatagagagattttataaatatcccaaatgaaagcatgcttttgtatgtgccatagaaccttgcaccttgcaacaagaaatagctcctagatatgagatgtaagaaaaaaatccatgatttaaagaaattattcaaaataatttcaactgacaaccctaataataaaagatgtgaatgaaaaaaaaaatttaagc

SEQ ID NO: 31757 - DNA, 401 bp, Homo sapiens
tttttgaaaccaggaggcagcatcttggacaattctgcagatgtgcttgatgagttagggacaaaaatggcccttctctgcacccctccttccctccctctataagggctcccatcgggggttgcttctccctccactgcctcccgggccctcccctcccttcttcagtggtcagctgagacccccacccactgcttgcttttgtactcttggcctttggacatactgacaggggcctttatgagaccccaatcaagacccccatgtcacaggtacctagtagggacaccagacctataaaaatatttgctacaaagtgaaatgattaacaaaaatgtgtgcactttgtgaaggggacaattgtttcaaaaactccaattagcacacacaggattttggat

SEQ ID NO: 31758 - DNA, 414 bp, Homo sapiens
tgccatactttttcatgtataagagttcttttttgttctgtgaacttttttaaaaaactaaaacatggtcttcatttcatggtatattctctggatttttaaaaaatttgttttcttttctctttactgaaggatctctttcctctaggctgccttcccgtttctgtgtgaggctctcctcagatggcctgcccatgtttaagagtgggggacgctgtagggatgggcactgccttctgtgagctgaacctttccttgttggggccttctgaccttagtgctgcgggttggtcctcccgggctattgtcacaagactctccctggtccctgcaggaaggggaggcttggctgcctgcatcctggagcccagtgagcgagggctgtagcctaatcagtaacctgattgtcccagg

SEQ ID NO: 31759 - DNA, 724 bp, Homo sapiens
agataaagcagacattaaaataaacagcatcactgaaggtatatagggccactatataatgtaaaaggaaaaattcaccaggaagttgctaaactcttacgtatttaacaacctagcctcaagacatttaagaattgcatgtaaacagcaaaccttaggggagatttaatacacctctgtgagtaattgatggccaagtttgtaaaaaattagtaaggataaaggagagcttgaataacaaaatactttttatataatggacatatatagaaaccatgcagtcagccgggcacgatagctcacgcctgtaatcccagcactttgggaggccgagacaggcagatcacaaggtcaggagttcaagaccagcctggccaacatagtgaaaccccgtctctactaaaaatacaaaaattagccaggcatggtggcgtgtgcctgtagtcctatctactcgggaggctgaggcaggagaatcacttgaacccaggaggcagaggttgtggtgagtcaagattgcgccactgcactccagcctcggcaacagagtgagactccatctcggagaaaaaaaacaaaacaaaaccatgcagtcataattcaagaattcttaatatttccaagcataaatggaaaatttatacaaactgaccaaggattattccaagagcacgtttcagtaaataccaaatattaatatcacatagattctgttctctgacca

SEQ ID NO: 31760 - DNA, 372 bp, Homo sapiens
cttttgttctctgaaatgacacccacagtctattcctctatagttcatatttttgatcctgcagatgcccaaatgtagagtgcagatcccctccaacaaacaccttaataactgagcagagtacaggggaagactagacgtttccttttatcatcatttaaggagttttccttatctgggtgaataacccaatacagccagactttcaagtgtatagtctgtgtctatgacaagacaaaacaaaagaaaagaaaacactggattgtaaacagatcaatccaatgttttctgttaccttaactaccagatcagattgctcacaaagtcaatctgatcaaatgttaagctattttgaaaacccaaatcaaccaa

SEQ ID NO: 31761 - DNA, 391 bp, Homo sapiens
tctgtgacccaggatgaacctcactgcaatctccacctcctgggttaaagcgattcttttgcctcagcctcccaagtagcatgagccaccacgcccggttaatttttgaatttttagtagagatggggtttcactgtgttggccaagctggtctcaaactcctgacctcaagtgatccgccctctctcagcctcccaaagtacagggattacaggcgtaacgccaccgtgcccggccttgctaactactttttgtctttcagtctttctggttatacgttgaaagttactttgaggaaacatttgatcttgcagactgggcagccttctggttgcatcctcttagaacaggggtccccaacccttgtactggtctgcagcctgttaggaac

SEQ ID NO: 31762 - DNA, 882 bp, Homo sapiens
cttacacataaagaagagtatatagtgtataattccatttatgtgaaattccaggaaagacaaatggaatccgtagttacagaaaacatcagtggcctcctggagctgggaatggggattgtctagaagcggcaccgaagaggatgaggggtgatgattaatagctgtatacatttgtcaaaacttcttaaaactgtacactttattgtatatagattgtacctcattaaaatttaccctgtgcaagcattggccatgtcagtaaactgcagcacctgttcttcttcacgttttttgtttttatttttgtttggatggcaggtaatcattcacctgtaaacaagcagggtgtaattttggaggtaccactagtctttagttctattccagctgtagggagggctggatagggtcagaagtaatgggattctttgctgctttcctctactacaggctgtttgggtcttctttggaagatgaagctttggctcttaaatccttattcctgggcaggatagctccagtttctttcagagaccgaaatattttcacctcccttccccactatcccagaaaaacatacttaatgttttagagaacactttgtttaactaatgaatctatcgttatttctcctgatagttctacttttggccacaaattgtttgatgctcaagtttgtctttagaacacagcagtttctcattatctgaggtattcgattagtgatacaaattagtttaaaactccaacaaaatatagtcataatgatattcagagctcccccacctaacttttggtgttggttatgctgtctggaatataaggctaattgggatagggtgtaatgatatatcactttgcgtcacttactagttagaa

SEQ ID NO: 31763 - DNA, 573 bp, Homo sapiens
  misc_feature (73)..(73): n is a, c, g, or t
  misc_feature (81)..(81): n is a, c, g, or t
ggagatgagggtgatagtgcccagctctgggctgctgctgtgagatcaagctgtgcaaacacaatggtcctgncctttggnaaaagcagaacaaacttgctagggcataaagcatcctccattctgcctggctgtccatcctctcaacagccccatgaagaaggggctctccccattttatggacaagaagacagactcagctgggtcaagtggcttgcccaggatcacacaggtcagctgtggaagacccagggcccctggcttcagtctttgggtccagctgtctcctccaggcagtgctgccagtgtccaggcatatggcttggcaaagtgggagaacctctgcttggggtctcgattggagaaaggaatggcttcctctcccctgatgtgagccgtcccagggccatgttgccgtaaggggtgcacagcctgtccactagcccagctgcggaagcacagctgtgtcccacgtgcagtgcctcagaaggagaggaagctttaggtgggggcccaagacccagattctgacatcagctctgccactgagaacagcgtgacctcaggcaagg

SEQ ID NO: 31764 - DNA, 565 bp, Homo sapiens
ttagcctaaggtgattggaatctgtctacaaattagttaagcctgacgttgatcattggacattcatccccgtttgtcaggcttaaattcaagtgctttggatgctgaatcaaattactgtggtagaaagaggtttaattttttccctaagaaaaatcttatctatggataagtagaaaccattctctgacaaccttgtaataattttgacagggaatgtaactgctgtgttctgcttttggttaaaggctaaagtacatattaggaaaatttgaggctgggcgcagtggctcacacctgtaatcccagcactttgtgaggccgacgcaggtggatcacttgaggtcagaatttgagaccagcctggccaacacagttaagccccatctctactaaaaatacaaaaattagccaggcatggtggcgggcacctgtaatcccagctacttggcaggatgaggcaggggaatcgcttgaacctgggaggcagaggttgcagtgagccattgcactccagcctgggcaacagagtgagaccctgtttcaaaacaaaacaaaacaaaac

SEQ ID NO: 31765 - DNA, 618 bp, Homo sapiens
atgcacacagggcacaaatggcctggagtggagacagcctctgtgaaggtagcaatagggctggggttcaaaatagccccaaattacttcatgtccaagagcacggacttgagtgcctatggagcctacggcatcctctcctcccatagctcctccatcggaagggctgcaggtagtgcccattcagaagtcggcagttgacaggtctgtgccaggctgctggatgaggtcacttattgcaaaaaaccttattatctttcattggcaagcacctggctcccaatcttaaaaggaggatttgtgaggcaggcattcagacactgcacagattgggcagaaaaagtccggatggaaagaataagcaggacactgagataggaaagagaaaaggaggaacagtgaaccagtgcccaatcacagtcctgtttctaagacactctagtatgggcctttccctgttaaagataaattacttatagaacatgtcatgcccctgatccagagtggagctttaatactctttgcctgcagttagaaataataagatttctccgaagtctctgggtctaaatccccaccagcgtgattaaacctttacatccttctaaaatagaggca

SEQ ID NO: 31766 - DNA, 401 bp, Homo sapiens
ctctttttgttattttttaatagagacacggtctggctatgttgttcagactggtttcgaactctggcctcaagtggtcctcccatcttggcttcccaaagtgctgggattacagatgtgagccaccatggctggccttaatactgttttatgagttctgaattgaataatttttaagtgaatgtcctaaaattctatgacaatccttttaacacaactggaagagtttttgttggcttacttggtttgtctgcatgtttccttctgtcatcccccactcctaggacccatatggaacattctctcttaattaactcttttattgaagtataatatacttagaggaaaaatgtccaaatcattttcacaagtgaacatacttgcgaaattagcacccagac

SEQ ID NO: 31767 - DNA, 1983 bp, Homo sapiens
agcggggtgcgcggggcggcgcgcggcgtgcaggtcgcagctgtggctcgggtgctggcaggtgctggcgggactggcggggatcgccgtggactgcctcaggggcgccgcagcccgctcggcccgagggcccgcctaaccgcgccgcccgcgcccgctcctcctcggcccgcgcccggagcgcgggggccgccggcgctgggtactcggcggccaccggggatcggggctgagcggtcggttcccgcccccgtgccgccgccgccgccttccggccgaccgcccggcttggccgctgctgccgcgtctggcccccgggtccccgccgctgggggcgcgggcggggtcgggggttgccgggcgccgccccccgtgcgcctggagtccacatcccgggcccggcggccggcgagcatggaggagaagtacctgcccgagctgatggcggagaaggactccctggacccctccttcacgcacgccctgcgcctggtgaaccaagaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaagaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaaaaaaaa

SEQ ID NO: 31768 - DNA, 1900 bp, Homo sapiens
agcggggtgcgcggggcggcgcgcggcgtgcaggtcgcagctgtggctcgggtgctggcaggtgctggcgggactggcggggatcgccgtggactgcctcaggggcgccgcagcccgctcggcccgagggcccgcctaaccgcgccgcccgcgcccgctcctcctcggcccgcgcccggagcgcgggggccgccggcgctgggtactcggcggccaccggggatcggggctgagcggtcggttcccgcccccgtgccgccgccgccgccttccggccgaccgcccggcttggccgctgctgccgcgtctggcccccgggtccccgccgctgggggcgcgggcggggtcgggggttgccgggcgccgccccccgtgcgcctggagtccacatcccgggcccggcggccggcgagcatggaggagaagtacctgcccgagctgatggcggagaaggactccctggacccctccttcacgcacgccctgcgcctggtgaaccaagaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatattggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaagaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaaaaaaaa

SEQ ID NO: 31769 - DNA, 1604 bp, Homo sapiens
gtccagtgaagagggttggagactgctcaagatcgacaaggagtaccttgctaaaaatggccacagaggaggaggagggtcctcctcctcctccttcacgcacgccctgcgcctggtgaaccaaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaagaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaaaaaaaa

SEQ ID NO: 31770 - DNA, 1679 bp, Homo sapiens
ggcggttgggggccgggtggaaacgcgggggcccagggggcccctccgtgccctctgctgtcagcggacgcggcggagacggaggcccgggtggcccccggggtcgtttgcacggggacctgggaggctgtgggacacctaggggaagaccctgatgtgaattttggggacttggaaggagaaggctggggcgcatggaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaagaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaaaaaaaa

SEQ ID NO: 31771 - DNA, 1696 bp, Homo sapiens
agcggggtgcgcggggcggcgcgcggcgtgcaggtcgcagctgtggctcgggtgctggcaggtgctggcgggactggcggggatcgccgtggactgcctcaggggcgccgcagcccgctcggcccgagggcccgcctaaccgcgccgcccgcgcccgctcctccccccgtgcgcctggagtccacatcccgggcccggcggccggcgagcatggaggagaagtacctgcccgagctgatggcggagaaggactccctggacccctccttcacgcacgccctgcgcctggtgaaccaagaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatattggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaagaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaaaaaaaa

SEQ ID NO: 31772 - DNA, 303 bp, Homo sapiens
cacggagacattaccacacggacacaccgtcacatggacacactggcacattcacatggacggacacacagacatacggagaaatccacacggacacaccaccacactatcacagggacacacagacacacggagacatcacatggacacaccaccacactatcacagggacacacagacacacaagagacatcactacactgtcacatggacacaccatcacaggaacacacaaacacactgccacatggacactgccacacacagacacaccgccacactgtcacatggacacacctccac

SEQ ID NO: 31773 - DNA, 759 bp, Homo sapiens
acacttattaatagtctttaaaaattttacctgtggaccaggttgaatttagtaatcctgggttagtttttagtgttatgggttagaacccagctgccaggtgctgttactcatcatgtagcacattgtcctggaagccagctgatttttcaatactgagttaattgacctggttctttgtagaaccatttgtggttagtaaggaaatatgcaaaatcacttgagatcaaataaagatcctctatcccataccatacgagccaacctcaataatttattttggctgcaatattttctgtgcaccagaaagtcttccttgatatttcgtcttcagttgttacagttagctttactctgcgtaaatgcactttagttttaatttatggtgtgaaccatttttgtggtcttatttctctaacacattatatgcccatataacaaattttcccagagatgcaaaaaaaaaaaaatcaaaatctccctcacaaattgaaaccagtgtgagtaaacaaaaatcaacagtatgctgtcatcatttgtttatactgaactataatgtttattataaagagaacgagatgtagcactcccctccctccactgtggttctttgctgccccacatgagctacctgctctttaatttttgaacattgggatgaatgaaatgttcagttgtgagaaaagctagttgtgccaaataagaatgaagtaactcttccaagattccccccaaacacttttaaattccatgttcatt

SEQ ID NO: 31774 - DNA, 386 bp, Homo sapiens
tttgagacagagtctggctctaccgcccaggctgaagtgcaatggcgcgatctcggctcactgcaagctccgcctcccgggttcacgccattctcctgcctcagcctcccgagtagctgagatggtaggatttgcttgagcccaggggttcaaggctgcaatgagccatgatagcaccactgcactccagcctgggcaacagtgagaacttgtctcataaaataaaataataaaatagattagccaggatgctctctgggaccaatgatcatcctatatcaaaccagcctaaacaaaaaagtgtttttggtaactggaatggatccaacaggaagaatgagcttatggaaccagagcaccttgaaaaacttgacagcccaggagtg

SEQ ID NO: 31775 - DNA, 348 bp, Homo sapiens
gaggtgctgaaaggtgttaagtaatattcccaaggacactcaactaggaaatatgagaaccaggttctgaatgcagacaatttgattccaaaactgcattcaactgcaaagctgtctcgtgaactgcacttagcagataagtggtggtactcaagccagaagtcaggtctgatctttcggttccatcattccatactgcctgttcctctgtcttctcaatgaataatgattgtcaagccactctaagtttttttagatatgtatttgctcattttggaaattacagaaaattacaaagaaaaatctataatctagccatctagaaataactatgcttatgattttaat

SEQ ID NO: 31776 - DNA, 330 bp, Homo sapiens
tgttttttttttgagacagagcttcactctgtcccccaagggtagagtgcagcaagtgtggcggtgcaatcatagcccactgcagcctggactcctcgcctcaagcaatccttccacctcagccttctgagtagttgagattataggcgtcaagccactgtgccccactacatcttggtcttttctgtatcttagttacatgcttgccttctcacccacaaaacacatcaggagtaaaaagcaaaaaaatcagtcaacaacacgacatatacacataaataagacatcttctcttttggatggttaggaagatctttaaagacactcaaa

SEQ ID NO: 31777 - DNA, 841 bp, Homo sapiens
catcctgcaccctcagaattcattctcagatcagcttcccagatttttgccaatatcaattaaaaaaattttttagccaaccatgtactgtgagtaagccaatatcaattagcaaaatctttaagtttcttttggtgattcagtatcttccccctggagttttttgatgattcagtaccctcctagatttggcccctggggcctgcggggatgtgacttgtcatttaattctggagaaaatgaggggtagggcttataaggagactccttcggggcagggtcattacagggtgtgttacatagggaaatgctagctgctggctagctctcgctcttgaaaggctcttcctccctcaactgaaatggggaagggggaaccccggccgactgaggtcctgacatctttagcacatggcttcttaggtcacccagggcatccaggttaccagcttgggaaacaggagatgtaggttggaggaagaggctacagcccaccctggaaataactgccatccgtcccacccatatggttaggctttgtgtccccacccagatctcatctcgaattacaatccccacgggttgagggatggaccaggtggaggtacttgcatcctgggggcagtttcccccatgctgtgctcgtgacagtgagtgagttctcacgagatctgatggttttaaagcgtggcagttcctctttctcgtgcttacatcctcgtaactatcctgtggagaaggtgtctgctttcccctacctccatggttgtaagtttcctgaagcctccccagccgtgtggaactgtgagtcaattaaacttctttataagttaaaaagtct

SEQ ID NO: 31778 - DNA, 398 bp, Homo sapiens
  misc_feature (47)..(47): n is a, c, g, or t
cagtgagccgagatcgcgccactgcactccagcctgggcggcagagngagactttgtctcaaaaaaaaaaaaaaagaaaaaaacagtttaccattctatcagaaaatgttgaccaccctcatatttttggtaaactgcagtaatttttccttaatactttttgcaagcttttgcatgcataagctccagtatcacacttaattttgcttgcttgctctctgaagggagttcggatgaccgttacagcaaagtggattttgcgtccaaagtgataagccaaatatcaggattttcccagtttctccgtaggactgatgtttagaggaaagccttccctgactcaaatatgtttctccatataaaaaggggaaagtaaaatgggttttctttctggtggt

SEQ ID NO: 31779 - DNA, 388 bp, Homo sapiens
agggcaggaaggtttggagcatgggaggagtaccaggattcagggggcacttgattcttggccgtagacgtccagccaccaagaagcctggctgcctttaccatgcgggtcattctcagggtgggagggttaagaaagctctagcttcgatttattctgtacttgaaaattctcttgcccaaataagtgcctttaaaaagtgaagttgctctgctctcctttcagactcctctaacataattttcttgtttagctgtaaggtaaagaaaactgcattataagaaaccacatttatggccgggctgggtaatcccagcactttgggagtctgaggcaatctgcatgaactcaggagtttgagaccagcctgggcaacatggcaaaaccc

SEQ ID NO: 31780 - DNA, 505 bp, Homo sapiens
ctattatgaatcatgcaactatgtatattattatacaggtcttttgtggacacatctccattatttttgggtaaatatttaggaatggaatgttggtcagctgtaggctccattttacaagaaactgccaaactgtcttccattctacacttttgtttgcaatgtatgaaagttctggttgcttcctatcctaatcaacatttggtgtgggactacaggaacatgccactacacctgattgattaaagaaaattttttgtagagacagggttttgctctattgcccaggctggtcttgaattcctggcctcaagtgatcctcccgcctcagccactcaaagctctgggattacaggtgtgagtcgccacgcccggccaaaatttattaattggtagttggcaattgttgatggaaaagaaaaagcaggttacaagcaatgtactttttgatgtctttggtattatcacaggcaaataaattatatatgtatatatattatgtata

SEQ ID NO: 31781 - DNA, 613 bp, Homo sapiens
ttccagtctgcgtggctttttattcctttttttgtgtgtcttagtatgatgactaaaatttctgtgttgaataagagcggcaggaactgacactgttaccttgtccccagtgtcagctggaaaacattctgtttttcactattaagtatgatgacagctataggttttgtgtacatattctctatcaagttgaaagagtttgacagctgggcctgcagtcactagaaatgctgtggtgctttattggaacaagctatgtatcaagaattgtgattttctgcaggcgttgctggaggaattttgacaaaggtagaagaatcaaataatggattattggttcatttgaaagatgacatatcctgtgtccttttgccatctggggctcccctctgctgatggagtatttgagaacctctatgaaggagccctggagagtgaaagttcccccagatttctgtgctcattaaacctgtagaactcttgaaaatgtgcaaggtgaagtaacaattttgatcaaacaaagctgtcagtttctgtcttgagattacagaagtaactctacaaggccaacatcccaagcacaggaaagaccagccactagggccgcagaccc

SEQ ID NO: 31782 - DNA, 428 bp, Homo sapiens
catggtgggaattcctgcctcaagtcttccatcagcttcctggcaggttggatttgatgctcctggctcatggtgggaattcctgcctcaagtcttccatcagcttcctggcaggttggatttgatgctcctggctcatggtgggaattcctgcctcaagtcctccatcagtttcccagcaagttggatttgatgagtcccaattcatctcccctcccaggaggacactgtctgcttatacagctggttctagtgttaacttatttcattgattttgtgtaccccattgtggagttaatcatccctgtgctccagaactcctcctagaatcaatgactaatgggaagattttcttctacctggttatccttccaaaaacttacgtgctaatctaagtggaaattctctaggaggaggaggaatgcgcg

SEQ ID NO: 31783 - DNA, 1379 bp, Homo sapiens
ccatgagtctatcgaaaattaggtctcagaccagaacagatcaaaatatttagtgctctctagggaaaaagcttttgagataaagtggaatttcttatttctaagaagtaggaaaagagtgttttgtttggtctctacaaattatagttatttggtttcagcctgaacaatcaccacaagcaaatactggcagaaagagtctctacaggagtggtcaaaaaagtcagttttcatttccttccaagccctagtttggctgatccatccacagaaaagcagaacaaaaggcaagggattactgcacccttaagcatccaagtggctcattcggctcgggggttatttttagcaatctggctcacactgagggcttcctgctctattcagcaaatgtgcaaatggatgctgcaggaccgtaacagtagacattgatgaagatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacgtattttgcttctagtatgtgcctactgtgatttttttcatgtggaaaatgcaaaatttgtaacaaaatggttatatggaacatgcctattaaacgaattttactatcttccctaa

SEQ ID NO: 31784 - DNA, 771 bp, Homo sapiens
gcgagtagctgggactacaggcgcccgccacctcgcctggctaattttttgtatttttggtagagacggggtttcaccgtgttagccaggatggtcttgatctcctgacctcgtgatccgcccgcctcggcctcccaaagtgctgggattacaggcgtgagccaccgcgccccggcagcaaaggtttttctttcgtttaaagatgacacactctgaaattaatttgattttgagatttgagaacttggacatacatacttcctatggaagattcaatgccatccccatcaagctaccaatgactttcttcacagaattggaaaaaactactttaaagttcatatggaaccaataaagagcctgcattgccaagtcaatcctaagccaaaagaacaaagctggaggcatcacactacctgacttcaaactatactacaaggctacagtaaccaaaacagcatggtactggtaccaaaacagagatgtagaccaatggaacagaattttttgtagttttttaaaaaatcacacattttgcagccttcgtgtatttgtataaatatctgtttacacattgctttgttttctggtattatttcttgttaattccttaaggaaacattgtagactcttatatatgccttgtatattcttgttcagtgaatgaataacttaagaacagaaatatgtcatgtagatatataaatttctgagaaataatctagtcctatctccaaattactgaagacaaagaaacagaaacttggagag

SEQ ID NO: 31785 - DNA, 691 bp, Homo sapiens
gagactgcgcatgcgcgtcactagacgacacggctgtcttctttcctggagaatttctcaaggactgctggctggaaacttaacggctaatgtggatctgaccgtagtttgccaaattaagaaaacgtttttaccctgttgaagatttgctttaacttcaaaagtgatgacaagaaagtatggacaccccttcaggaccaacctgataagtcactgggtttttgtaatctcgcaatattgaaatcaagagacatcacagaacacagcagcaaagagacggggtttcaccgtgttagccaggatggtcttgatctcctgacctcgtgatccgcccgcctcggcctcccaaagtgctgggattacaggcgtgagccaccgcgccccggcagcaaaggagttaggacctttgggaagtgaatgagatcagtgctcttataaattggctccagagagctccttcgtccctttcaccatgtgaggacacagctagaagacaccatctgtgaaccagaaagtgagtccttatcagacactgaatctgctggcaccttgacttcttagccttcagaaatgtgagaattaaatttctgttgtttataagatacacaatttatgatatgttgttataacagcccaaacatatatgatgtattgaaatcttctatgaaaaattgtgtgattttcctcaatt

SEQ ID NO: 31786 - DNA, 1399 bp, Homo sapiens
agaaaaaagctaccgtggcacgtgccccggggagtgatgcggtggcccggtttgcacggagagcgggacaccgcctggggagccgcgctcgtagcctgggggcgggacgcggcggccgctccctccgcccccgagtagctgccaccgcctggctgcgccccagcccagtagctcagacgcggccgcatcccggtggactgtagaggcggcagcgagctagagcccgagtcgcagctccgggccgcagagcgctgggcgagcgcgagcgccagggcaccggcagggcaggcagctgcgcgcggctggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacgtattttgcttctagtatgtgcctactgtgatttttttcatgtggaaaatgcaaaatttgtaacaaaatggttatatggaacatgcctattaaacgaattttactatcttccctaa

SEQ ID NO: 31787 - DNA, 1118 bp, Homo sapiens
gagacgcggcgcatcccggtggacgagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacgtattttgcttctagtatgtgcctactgtgatttttttcatgtggaaaatgcaaaatttgtaacaaaatggttatatggaacatgcctattaaacgaattttactatcttccctaa

SEQ ID NO: 31788 - DNA, 1397 bp, Homo sapiens
gagactgcgcatgcgcgtcactagacgacacggctgtcttctttcctggagaatttctcaaggactgctggctggaaacttaacggctaatgtggatctgaccgtagtttgccaaattaagaaaacgtttttaccctgttgaagatttgctttaacttcaaaagtgatgacaagaaagtatggacaccccttcaggaccaacctgataagtcactggtttttctttcgtttaaagatgacacactctgaaattaatttgattttgagatttgagaacttggacatacatacttcctatggaaggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacgtattttgcttctagtatgtgcctactgtgatttttttcatgtggaaaatgcaaaatttgtaacaaaatggttatatggaacatgcctattaaacgaattttactatcttccctaa

SEQ ID NO: 31789 - DNA, 1591 bp, Homo sapiens
gagactgcgcatgcgcgtcactagacgacacggctgtcttctttcctggagaatttctcaaggactgctggctggaaacttaacggctaatgtggatctgaccgtagtttgccaaattaagaaaacgtttttaccctgttgaagatttgctttaacttcaaaagtgatgacaagaaagtatggacaccccttcaggaccaacctgataagtcactgatggagtctcactctgttgcccaggctggagtccagtggtgcgatctcggctcactgcaagctctgcctcccaggtttttctttcgtttaaagatgacacactctgaaattaatttgattttgagatttgagaacttggacatacatacttcctatggaagagtctcactctgttgcttaggctagagtacagtggtgctatctcaactcactgcaacctccacctcctgagttcaagcgattctcctgcctcagactctctggagtagctgcaattataggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacgtattttgcttctagtatgtgcctactgtgatttttttcatgtggaaaatgcaaaatttgtaacaaaatggttatatggaacatgcctattaaacgaattttactatcttccctaa

SEQ ID NO: 31790 - DNA, 1157 bp, Homo sapiens
cctatgcgaggagggaggagtgggacttgggaagtcgggggagactgacccagggaagatgtggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacgtattttgcttctagtatgtgcctactgtgatttttttcatgtggaaaatgcaaaatttgtaacaaaatggttatatggaacatgcctattaaacgaattttactatcttccctaa

SEQ ID NO: 31791 - DNA, 1458 bp, Homo sapiens
gagactgcgcatgcgcgtcactagacgacacggctgtcttctttcctggagaatttctcaaggactgctggctggaaacttaacggctaatgtggatctgaccgtagtttgccaaattaagaaaacgtttttaccctgttgaagatttgctttaacttcaaaagtgatgacaagaaagtatggacaccccttcaggaccaacctgataagtcactggtttttctttcgtttaaagatgacacactctgaaattaatttgattttgagatttgagaacttggacatacatacttcctatggaaggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttgctgaagcttcagagatcacctgccaaacacaggctgaacctgacagcatgtcacaccaggatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacgtattttgcttctagtatgtgcctactgtgatttttttcatgtggaaaatgcaaaatttgtaacaaaatggttatatggaacatgcctattaaacgaattttactatcttccctaa

SEQ ID NO: 31792 - DNA, 1504 bp, Homo sapiens
ccatgagtctatcgaaaattaggtctcagaccagaacagatcaaaatatttagtgctctctagggaaaaagcttttgagataaagtggaatttcttatttctaagaagtaggaaaagagtgttttgtttggtctctacaaattatagttatttggtttcagcctgaacaatcaccacaagcaaatactggcagaaagagtctctacaggagtggtcaaaaaagtcagttttcatttccttccaagccctagtttggctgatccatccacagaaaagcagaacaaaaggcaagggattactgcacccttaagcatccaagtggctcattcggctcgggggttatttttagcaatctggctcacactgagggcttcctgctctattcagcaaatgtgcaaatggatgctgcaggaccgtaacagtagacattgatgaaggttgtgatcaatgattagactctcaagcctgttgtgtttttgatctagccatgcctttcaaccactgtggtgaacatttagctctgaataggctcatcttcttcatatgcacattctatttgtagatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacgtattttgcttctagtatgtgcctactgtgatttttttcatgtggaaaatgcaaaatttgtaacaaaatggttatatggaacatgcctattaaacgaattttactatcttccctaa

SEQ ID NO: 31793 - DNA, 1562 bp, Homo sapiens
agaaaaaagctaccgtggcacgtgccccggggagtgatgcggtggcccggtttgcacggagagcgggacaccgcctggggagccgcgctcgtagcctgggggcgggacgcggcggccgctccctccgcccccgagtagctgccaccgcctggctgcgccccagcccagtagctcagacgcggccgcatcccggtggactgtagaggcggcagcgagctagagcccgagtcgcagctccgggccgcagagcgctgggcgagcgcgagcgccagggcaccggcagggcaggcagctgcgcgcggctggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttcacctgtgccacaggccaccatggatctgcacctcgatgcccttcggagtcatgagagtgcaagcaatagcagctcaggaagcagcagcagaggagaccagaaaggtcactacctttgcatgaacaacaatggcaaccaggataccatgcttggttctccatgatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacgtattttgcttctagtatgtgcctactgtgatttttttcatgtggaaaatgcaaaatttgtaacaaaatggttatatggaacatgcctattaaacgaattttactatcttccctaa

SEQ ID NO: 31794 - DNA, 1735 bp, Homo sapiens
  misc_feature (1418)..(1418): n is a, c, g, or t
agaaaaaagctaccgtggcacgtgccccggggagtgatgcggtggcccggtttgcacggagagcgggacaccgcctggggagccgcgctcgtagcctgggggcgggacgcggcggccgctccctccgcccccgagtagctgccaccgcctggctgcgccccagcccagtagctcagacgcggccgcatcccggtggactgtagaggcggcagcgagctagagcccgagtcgcagctccgggccgcagagcgctgggcgagcgcgagcgccagggcaccggcagggcaggcagctgcgcgcggctggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacgtattttgcttctagtatgtgcctactgtgatttttttcatgtggaaaatgcaaaatttgtaacaaaatggttatatggaacatgcctattaaacgaattttactatcttccctaaaaaaaaaaaaaaaaaaaanaaaaaaaaactgttgttgggccgcgccttgggacctctgaaaagagtttttagaaacccaattcgttgtggggccgcgggggccccattggtgttagggaccctgtggccaaagcgtgtcccagaaggaaacccggggccacagcaagaagggttggggagtttctcccccaattaaaaaaaccccgcggggagcaaccccaagctgtgttctcgacccaattcccgaaatgagagttcagaagggccataagggggttcttatccaggggatgtcacaagagagcccaatttaaattagcggattagtgggagacc

SEQ ID NO: 31795 - DNA, 1451 bp, Homo sapiens
ccatgagtctatcgaaaattaggtctcagaccagaacagatcaaaatatttagtgctctctagggaaaaagcttttgagataaagtggaatttcttatttctaagaagtaggaaaagagtgttttgtttggtctctacaaattatagttatttggtttcagcctgaacaatcaccacaagcaaatactggcagaaagagtctctacaggagtggtcaaaaaagtcagttttcatttccttccaagccctagtttggctgatccatccacagaaaagcagaacaaaaggcaagggattactgcacccttaagcatccaagtggctcattcggctcgggggttatttttagcaatctggctcacactgagggcttcctgctctattcagcaaatgtgcaaatggatgctgcaggaccgtaacagtagacattgatgaaggttgtgatcaatgattagactctcaagcctgttgtgtttttgatctagccatgcctttcaaccactgtggtgaacatttagctctgaataggctcatcttcttcatatgcacattctatttgtagatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctatatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacgtattttgcttctagtatgtgcctactgtgatttttttcatgtggaaaatgcaaaatttgtaacaaaatggttatatggaacatgcctattaaacgaattttactatcttccctaa

SEQ ID NO: 31796 - DNA, 705 bp, Homo sapiens
tatactgaaaagacacttcatcaagataactctgggagaagcagaaaaccctgtgccagggacaggaaagataggagtaagtatatttttgttccattgatcttggaacatatggaataatatattgaagatgttcctaaaaatatatttgttgctataaagccagatgacagcaaagaaaatgtaaggtgggatatcttcattttagaaaacaatgtagtttaatataagattgatagaatatattgttaatttctaattaatagcaaacgatacatactgggaccttgagatacacattttcaactcatatctgccagggataagtgagcttggtttgatatttccactcttagctgtgcctacttaaatggttcttatagaggcagctagcccatcagaatagtattttgaaatttatagcctttaaaatagaagagaaattcatactgcctatcaggtcttataaactgactgcttttcttattactactctcctcagagaccatagtaatagaattataatcagtacctacaattaaatattcttgatgacactaataggtgaacataaacctcaagttaatacttgtttgagagacaggtttttgtgtgctggtatctcacagatatctgtcctatctatctatctatctatctatctatctatctatctatctatccatctatctatgacagatatct

SEQ ID NO: 31797 - DNA, 513 bp, Homo sapiens
ctttccaatattttccgaatttttaaaaagaaatccctttgaactgtcaaagcatgatgctatggtctgaatatctgtgtcccccctgcaaatctacatgttgaaacttaatcaccaatgttactgtgttaggagttaggacctttgggaagtgaatgagatcagtgctcttataaattggctccagagagctccttcgtccctttcaccatgtgaggacacagctagaagacaccatctgtgaaccagaaagtgagtccttatcagacactgaatctgctggcaccttgacttcttagccttcagaaatgtgagaattaaatttctgttgtttataagatacacaatttatgatatgttgttataacagcccaaacatatatgatgtattgaaatcttctatgaaaaattgtgtgattttcctcaatttcttcatgtttctaacagattttattttattatgcatatctgaagctgtgcttttcagcatataaatgtttattgttctataac

SEQ ID NO: 31798 - DNA, 169 bp, Homo sapiens
gacagtcaccaggctagacatggtgatcagagagctctagcctgagctctggtaagcaggaatgaagtactgactggttaaggcactgttttctcattgcatttacaggctgaagcttcagagatcacctgccaaacacaggctgaacctgacagcatgtcacaccagg

SEQ ID NO: 31799 - DNA, 344 bp, Homo sapiens
atttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacgtattttgcttctagtatgtgcctactgtgatttttttcatgtggaaaatgcaaaatttgtaacaaaatggttatatggaacatgcctattaaacgaattttactatcttccctaactttggtctgtgtatgtgtgtgtgttttactttaatatgaattatacaaaatactagttgttttacactc

SEQ ID NO: 31800 - DNA, 1332 bp, Homo sapiens
agaaaaaagctaccgtggcacgtgccccggggagtgatgcggtggcccggtttgcacggagagcgggacaccgcctggggagccgcgctcgtagcctgggggcgggacgcggcggccgctccctccgcccccgagtagctgccaccgcctggctgcgccccagcccagtagctcagacgcggccgcatcccggtggactgtagaggcggcagcgagctagagcccgagtcgcagctccgggccgcagagcgctgggcgagcgcgagcgccagggcaccggcagggcaggcagctgcgcgcggctggagtcatgctatactgaaaagacacttcatcaagataactctgggagaagcagaaaaccctgtgccagggacaggaaagataggaatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacgtattttgcttctagtatgtgcctactgtgatttttttcatgtggaaaatgcaaaatttgtaacaaaatggttatatggaacatgcctattaaacgaattttactatcttccctaa

SEQ ID NO: 31801 - DNA, 2880 bp, Homo sapiens
gtcgaccctctctcaccacccatccaggagttttatattctcctgtaaaataagcatgttgtgagaagttccctgaggaaatttgaagacaagtgtatgagagctctggagccccatccccctgccctgagcatagtcgccaaaaggactttccacttagtttacttcatgcttgcttttgagcctgcggcaaaaaattctaccttctgagtgactgtgggtggagggagggcctgagatgacatcaaatcacagtctttcctcctcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtgaatgtgtttgtgatggggatgaccaagacttttgcaattttctttgtggtctttcaagaagagtttgaaggcacctcagagcaaattggttggattggatccatcatgtcatctcttcgtttttgtgcaggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaattgctttaa

SEQ ID NO: 31802 - DNA, 697 bp, Homo sapiens
gatatttgggaacacgtgctcatgcactatggaaaatatacttactgtgtcacatacgagggactacagcgtgggaaaatgatagtctatacaatcatgaaattggtggggtgagaggattaacaagtatagaccttgagtccatatgaaaaggaagtgaagacgtgattacaggggatgatgtcactggggagtggcaaggatagacgtgatatcggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaattgctttaa

SEQ ID NO: 31803 - DNA, 2747 bp, Homo sapiens
gtcgaccctctctcaccacccatccaggagttttatattctcctgtaaaataagcatgttgtgagaagttccctgaggaaatttgaagacaagtgtatgagagctctggagccccatccccctgccctgagcatagtcgccaaaaggactttccacttagtttacttcatgcttgcttttgagcctgcggcaaaaaattctaccttctgagtgactgtgggtggagggagggcctgagatgacatcaaatcacagtctttcctcctcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaattgctttaa

SEQ ID NO: 31804 - DNA, 2603 bp, Homo sapiens
gtcgaccctctctcaccacccatccaggagttttatattctcctgtaaaataagcatgttgtgagaagttccctgaggaaatttgaagacaagtgtatgagagctctggagccccatccccctgccctgagcatagtcgccaaaaggactttccacttagtttacttcatgcttgcttttgagcctgcggcaaaaaattctaccttctgagtgactgtgggtggagggagggcctgagatgacatcaaatcacagtctttcctcctcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaattgctttaa

SEQ ID NO: 31805 - DNA, 1955 bp, Homo sapiens
tagaggatcccagcggggaacaatcactttggatatggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaattgctttaa

SEQ ID NO: 31806 - DNA, 2243 bp, Homo sapiens
gtcgaccctctctcaccacccatccaggagttttatattctcctgtaaaataagcatgttgtgagaagttccctgaggaaatttgaagacaagtgtatgagagctctggagccccatccccctgccctgagcatagtcgccaaaaggactttccacttagtttacttcatgcttgcttttgagcctgcggcaaaaaattctaccttctgagtgactgtgggtggagggagggcctgagatgacatcaaatcacagtctttcctcctcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaattgctttaa

SEQ ID NO: 31807 - DNA, 2150 bp, Homo sapiens
gtcgaccctctctcaccacccatccaggagttttatattctcctgtaaaataagcatgttgtgagaagttccctgaggaaatttgaagacaagtgtatgagagctctggagccccatccccctgccctgagcatagtcgccaaaaggactttccacttagtttacttcatgcttgcttttgagcctgcggcaaaaaattctaccttctgagtgactgtgggtggagggagggcctgagatgacatcaaatcacagtctttcctcctcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtgaatgtgtttgtgatggggatgaccaagacttttgcaattttctttgtggtctttcaagaagagtttgaaggcacctcagagcaaattggttggattggatccatcatgtcatctcttcgtttttgtgcaggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggtaacaccttcaccacattctgaacaaatttcaatagcaataaaagagaaaaactgatccaggattaatggtaacatgtaatgatggtatcaggttaaaagaaacagattatttctgcttttcctatatctactcactccaccaccaatgcaggaaaatctgaaggctcagattcttgtattatcttaagatgtgccttaagcagattcttatattcttgggagttgtagggcagacactggatctatgtctacttgtctggggagacaatccagagttttttcagagcctcaaagacccatgatgctttaaa

SEQ ID NO: 31808 - DNA, 1568 bp, Homo sapiens
gtcgaccctctctcaccacccatccaggagttttatattctcctgtaaaataagcatgttgtgagaagttccctgaggaaatttgaagacaagtgtatgagagctctggagccccatccccctgccctgagcatagtcgccaaaaggactttccacttagtttacttcatgcttgcttttgagcctgcggcaaaaaattctaccttctgagtgactgtgggtggagggagggcctgagatgacatcaaatcacagtctttcctcctcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtgaatgtgtttgtgatggggatgaccaagacttttgcaattttctttgtggtctttcaagaagagtttgaaggcacctcagagcaaattggttggattggatccatcatgtcatctcttcgtttttgtgcaggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaattgctttaa

SEQ ID NO: 31809 - DNA, 1059 bp, Homo sapiens
gtcgaccctctctcaccacccatccaggagttttatattctcctgtaaaataagcatgttgtgagaagttccctgaggaaatttgaagacaagtgtatgagagctctggagccccatccccctgccctgagcatagtcgccaaaaggactttccacttagtttacttcatgcttgcttttgagcctgcggcaaaaaattctaccttctgagtgactgtgggtggagggagggcctgagatgacatcaaatcacagtctttcctcctcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtgaatgtgtttgtgatggggatgaccaagacttttgcaattttctttgtggtctttcaagaagagtttgaaggcacctcagagcaaattggttggattggatccatcatgtcatctcttcgtttttgtgcaggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggtacgtcattctaagtttatttactatcaact

SEQ ID NO: 31810 - DNA, 338 bp, Homo sapiens
cttggtcttttctcctcagtcagttagcatacttcatccctacctttcacctggtagccagagccaaaacactggggattgacatcatggatgcctcttaccttgtttctgtagcaggtaagaaagcctacatcagcctcctacccaaaaggaaagatcaacttaattttacaagcttattacattttaataaaaagctaaagaaaaacaaaagaggaattgtagaagggccagagaaagtaaaatttttgaggctagatggagcacctgggcatttcccaggaagagatctctgtcactgcacacaggctcccctactagacagtggaccctaaatc

SEQ ID NO: 31811 - DNA, 1185 bp, Homo sapiens
tgccagcctagtacaaggtccacattacaagccaaagctcagaaatttctggaggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccagtggtggcaaacccaaggccatgtgagtttgataaaatccagtctgtaccactcacacttctcaagtaacctcccaacttctctccctgcattcactctggctttcctacaatcaatgttgtacaaagaaatcagaattacatttttaaaaaatgtaactcagaacatgtttctctcctgcttaaaagactccaccatctcccttctcatctagaataaaccaggcctctggctaccacttggacctttattgcccttcctgctttcttcctccaacagctctgaccttcactctgttcctctttcatcacaagctcatctatattccaggacttcacatttgttatttcttctgtctactctgtctctcaagacaatagaggtcacagcaaatacaaacctttatactaatggattttgttttcttcttggaccctccatagcaaccaagagatgtttaaactctcatccatggatgttacccatgctcacttggtgaataaattctggcattttggtggtaa

SEQ ID NO: 31812 - DNA, 2126 bp, Homo sapiens
tgccagcctagtacaaggtccacattacaagccaaagctcagaaatttctggaggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccagtggtggcaaacccaaggccatcaaccaagagatgtttaaactctcatccatggatgttacccatgctcacttggtgaataaattctggcattttggtggtaatgagaggagccagagattcattgagcgctgcattcagacctttcccacctgctgtctcctggggcctgaggggacccctgtgtgctgggatctaatggaccagactggagagatgagaatggcaggcaccttgccggaataccggctccatggccttgtgacgtatgtcatctattcccacgcccagaaattgggcaaacttgggtttcctgtctattctcatgtagactacagcaatgaagctatgcaaaaaatgagttacacactgcaacatgttcccattcccagaagctggaaccagtggaactgtgtacctctgtgatgccaatcctgaacataagacagtgttgggcaggtctgggcgtataatttgaggagtggatggtggatgaaaagaaataataaattgtaatcagcagtaaaggagtgggcactgtttggactctggggaagcagtgtgatgttcaacagcatcgccatggtccctgcattcacaggtttctcagtgggaagcaggcccaggtcctcttacatttgacataagcaatttacctccccacatttccaggacctctatgacacttcatcagatacatattgctccaaattacttctcctggaatccctggttcctcagttgcaagacccttgccagtttttctgggagctaggaagaggtgaattaaattttctgagcactatgacttctttctttctaaagcctttcccttatgatcaacaagtggactctcctcagcaggtctttagagattatcctctcctgttattgctactttataggtacattaaatatactggacacaaatatatatgggatattaggctaaatacagtatacatgatatagcagggaatgttactagaagaaatatcaactgatgatatcctatcctctccaagctcctattccaggaaaaaagatccaatgttttttctaaagatgagcttccaaaacccacaactcctaaataatacagaaagttttgtgtttgactgtatacaatttttattgtgtttgttcaagctaagtggttcatcatggtgacagcatgaaaggaatgagtgtatgaaaaggtgaaggtgggagcaccttgacccagggatgtgatggtttattgaggagagataggagttgaagggagaggagacagcatgaacacctgcttgtccaattagcctcagcacattactaatctcagtttgttcctgctgtaacaaaatacctgagactgggtaattcataaataacagtctgaacttatttgtttatttaaaataataataaaataattaaaaatttatttatcccagttctggaggctggaagtctaaaatcatggt

SEQ ID NO: 31813 - DNA, 2012 bp, Homo sapiens
cagtgacagtccttgtgctctggttagattccatatccctgaacttcaacctgaaaacttccatcagctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccagtggtggcaaacccaaggccatcaaccaagagatgtttaaactctcatccatggatgttacccatgctcacttggtgaataaattctggcattttggtggtaatgagaggagccagagattcattgagcgctgcattcagacctttcccacctgctgtctcctggggcctgaggggacccctgtgtgctgggatctaatggaccagactggagagatgagaatggcaggcaccttgccggaataccggctccatggccttgtgacgtatgtcatctattcccacgcccagaaattgggcaaacttgggtttcctgtctattctcatgtagactacagcaatgaagctatgcaaaaaatgagttacacactgcaacatgttcccattcccagaagctggaaccagtggaactgtgtacctctgtgatgccaatcctgaacataagacagtgttgggcaggtctgggcgtataatttgaggagtggatggtggatgaaaagaaataataaattgtaatcagcagtaaaggagtgggcactgtttggactctggggaagcagtgtgatgttcaacagcatcgccatggtccctgcattcacaggtttctcagtgggaagcaggcccaggtcctcttacatttgacataagcaatttacctccccacatttccaggacctctatgacacttcatcagatacatattgctccaaattacttctcctggaatccctggttcctcagttgcaagacccttgccagtttttctgggagctaggaagaggtgaattaaattttctgagcactatgacttctttctttctaaagcctttcccttatgatcaacaagtggactctcctcagcaggtctttagagattatcctctcctgttattgctactttataggtacattaaatatactggacacaaatatatatgggatattaggctaaatacagtatacatgatatagcagggaatgttactagaagaaatatcaactgatgatatcctatcctctccaagctcctattccaggaaaaaagatccaatgttttttctaaagatgagcttccaaaacccacaactcctaaataatacagaaagttttgtgtttgactgtatacaatttttattgtgtttgttcaagctaagtggttcatcatggtgacagcatgaaaggaatgagtgtatgaaaaggtgaaggtgggagcaccttgacccagggatgtgatggtttattgaggagagataggagttgaagggagaggagacagcatgaacacctgcttgtccaattagcctcagcacattactaatctcagtttgttcctgctgtaacaaaatacctgagactgggtaattcataaataacagtctgaacttatttgtttatttaaaataataataaaataattaaaaatttatttatcccagttctggaggctggaagtctaaaatcatggt

SEQ ID NO: 31814 - DNA, 764 bp, Homo sapiens
tgccagcctagtacaaggtccacattacaagccaaagctcagaaatttctggaggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccagtggtggcaaacccaaggccatcaaccaagagatgtttaaactctcatccatggatgttacccatgctcacttggtgaataaattctggcattttggtggtaa

SEQ ID NO: 31815 - DNA, 804 bp, Homo sapiens
tgccagcctagtacaaggtccacattacaagccaaagctcagaaatttctggaggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccagtggtggcaaacccaaggccattgggagtttggtaaaaaacccaagttttttccccattccaaccctttaaaggaaaccccccaaaaattttctccgcggataaacaggggggtttccaaaaaaaaaggggggcaaaaaaaaa

SEQ ID NO: 31816 - DNA, 481 bp, Homo sapiens
tgccagcctagtacaaggtccacattacaagccaaagctcagaaatttctggaggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatcccctacagattcaaagttcacagcctagcctgaatgagg

SEQ ID NO: 31817 - DNA, 458 bp, Homo sapiens
tgccagcctagtacaaggtccacattacaagccaaagctcagaaatttctggaggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtgataatggaaaattctgagaggagtaaagaagacaaacttgatgtgaaagaggagggaaagggactgatatttatgatgcacctattttgagccaggcactatttcatgttttctctcatttagtatgccttacctctctacaagatgtttactgtcatgtccatgttgctgttaagaaa

SEQ ID NO: 31818 - DNA, 468 bp, Homo sapiens
tgccagcctagtacaaggtccacattacaagccaaagctcagaaatttctggaggtggtgtatcaaaatttactctgcgagactctgctgaactggctgcatcagggagaaatttcatctcccagaagggtgttgctcatcgtttcttcccggaaacatctgcagagactagcttttcaggtgaggactcattacaaagtatcagatacataggatgaacaagtctagagatctaatgtacaacatgagaactatagttaatagaattgcattgtatatgggatccatgctacatgagtggagtttagctgctctttacataaaaacaacgacaaaaaataagtaactatgtgaagtaatagatatattaatttgcttcataatggtaatgttttcactatctgtatgctctcataacatcatattgtatactttaaatatccacaataaaatttatttttttaatgt

SEQ ID NO: 31819 - DNA, 2547 bp, Homo sapiens
tgccagcctagtacaaggtccacattacaagccaaagctcagaaatttctggaggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccagtggtggcaaacccaaggccatgtgagtttgataaaatccagtctgtaccactcacacttctcaagtaacctcccaacttctctccctgcattcactctggctttcctacaatcaatgttgtacaaagaaatcagaattacatttttaaaaaatgtaactcagaacatgtttctctcctgcttaaaagactccaccatctcccttctcatctagaataaaccaggcctctggctaccacttggacctttattgcccttcctgctttcttcctccaacagctctgaccttcactctgttcctctttcatcacaagctcatctatattccaggacttcacatttgttatttcttctgtctactctgtctctcaagacaatagaggtcacagcaaatacaaacctttatactaatggattttgttttcttcttggaccctccatagcaaccaagagatgtttaaactctcatccatggatgttacccatgctcacttggtgaataaattctggcattttggtggtaatgagaggagccagagattcattgagcgctgcattcagacctttcccacctgctgtctcctggggcctgaggggacccctgtgtgctgggatctaatggaccagactggagagatgagaatggcaggcaccttgccggaataccggctccatggccttgtgacgtatgtcatctattcccacgcccagaaattgggcaaacttgggtttcctgtctattctcatgtagactacagcaatgaagctatgcaaaaaatgagttacacactgcaacatgttcccattcccagaagctggaaccagtggaactgtgtacctctgtgatgccaatcctgaacataagacagtgttgggcaggtctgggcgtataatttgaggagtggatggtggatgaaaagaaataataaattgtaatcagcagtaaaggagtgggcactgtttggactctggggaagcagtgtgatgttcaacagcatcgccatggtccctgcattcacaggtttctcagtgggaagcaggcccaggtcctcttacatttgacataagcaatttacctccccacatttccaggacctctatgacacttcatcagatacatattgctccaaattacttctcctggaatccctggttcctcagttgcaagacccttgccagtttttctgggagctaggaagaggtgaattaaattttctgagcactatgacttctttctttctaaagcctttcccttatgatcaacaagtggactctcctcagcaggtctttagagattatcctctcctgttattgctactttataggtacattaaatatactggacacaaatatatatgggatattaggctaaatacagtatacatgatatagcagggaatgttactagaagaaatatcaactgatgatatcctatcctctccaagctcctattccaggaaaaaagatccaatgttttttctaaagatgagcttccaaaacccacaactcctaaataatacagaaagttttgtgtttgactgtatacaatttttattgtgtttgttcaagctaagtggttcatcatggtgacagcatgaaaggaatgagtgtatgaaaaggtgaaggtgggagcaccttgacccagggatgtgatggtttattgaggagagataggagttgaagggagaggagacagcatgaacacctgcttgtccaattagcctcagcacattactaatctcagtttgttcctgctgtaacaaaatacctgagactgggtaattcataaataacagtctgaacttatttgtttatttaaaataataataaaataattaaaaatttatttatcccagttctggaggctggaagtctaaaatcatggt

SEQ ID NO: 31820 - DNA, 2072 bp, Homo sapiens
tgccagcctagtacaaggtccacattacaagccaaagctcagaaatttctggaggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacatatggcagctgaaacagccaaggaactgactcctttcctgctgaaatcaaagattttatctcccagtggtggcaaacccaaggccatcaaccaagagatgtttaaactctcatccatggatgttacccatgctcacttggtgaataaattctggcattttggtggtaatgagaggagccagagattcattgagcgctgcattcagacctttcccacctgctgtctcctggggcctgaggggacccctgtgtgctgggatctaatggaccagactggagagatgagaatggcaggcaccttgccggaataccggctccatggccttgtgacgtatgtcatctattcccacgcccagaaattgggcaaacttgggtttcctgtctattctcatgtagactacagcaatgaagctatgcaaaaaatgagttacacactgcaacatgttcccattcccagaagctggaaccagtggaactgtgtacctctgtgatgccaatcctgaacataagacagtgttgggcaggtctgggcgtataatttgaggagtggatggtggatgaaaagaaataataaattgtaatcagcagtaaaggagtgggcactgtttggactctggggaagcagtgtgatgttcaacagcatcgccatggtccctgcattcacaggtttctcagtgggaagcaggcccaggtcctcttacatttgacataagcaatttacctccccacatttccaggacctctatgacacttcatcagatacatattgctccaaattacttctcctggaatccctggttcctcagttgcaagacccttgccagtttttctgggagctaggaagaggtgaattaaattttctgagcactatgacttctttctttctaaagcctttcccttatgatcaacaagtggactctcctcagcaggtctttagagattatcctctcctgttattgctactttataggtacattaaatatactggacacaaatatatatgggatattaggctaaatacagtatacatgatatagcagggaatgttactagaagaaatatcaactgatgatatcctatcctctccaagctcctattccaggaaaaaagatccaatgttttttctaaagatgagcttccaaaacccacaactcctaaataatacagaaagttttgtgtttgactgtatacaatttttattgtgtttgttcaagctaagtggttcatcatggtgacagcatgaaaggaatgagtgtatgaaaaggtgaaggtgggagcaccttgacccagggatgtgatggtttattgaggagagataggagttgaagggagaggagacagcatgaacacctgcttgtccaattagcctcagcacattactaatctcagtttgttcctgctgtaacaaaatacctgagactgggtaattcataaataacagtctgaacttatttgtttatttaaaataataataaaataattaaaaatttatttatcccagttctggaggctggaagtctaaaatcatggt

SEQ ID NO: 31821 - DNA, 602 bp, Homo sapiens
ttttttttttttagagatagggtcttgctatgttgcccagactggtcatgaattcctggttttaagcaatcctcctgcgtcatcctcctgagtagttgggattacaggcatgagccagcgggcccagcttaaacccacatttactaagagatgactgtgaggtcactactttgcgtatatattacctcattgttcataaagttaaaaaggccgtgtcttctgcttatggggaaatggaaggaagctcactctttgttaacagtcattttacaatatgaaagacttgctcattgtagataatttggaaagtatagaagagtatagaggaaataaaaacaacccagaatatattacctggagagaacttacatgtatacctttacatgtatgcctttacatgtataccttttgaacaaaatcactcttttaaagtgatttcataaatttatagctaacttaatgtaatctcataactcaaatttttgtcataccacagtgtgaaatcctaactgtatttttgaactaagtgacccctgtgcttttctcttgtgaaataaataccttttgaaaagctctctgaaagtttaactcaggttttggtt

SEQ ID NO: 31822 - DNA, 960 bp, Homo sapiens
  misc_feature (272)..(272): n is a, c, g, or t
  misc_feature (828)..(829): n is a, c, g, or t
atgccattcccaaactgctcagcccccagcactgtggtggccacagctgtgggtgtcttgctggggctggagtgtgggctgggtctgctgggcaacgcggtggcgctgtggaccttcctgttccgggtcagggtgtggaagccgtacgctgtctacctgctcaacctggccctggctgacctgctgttggctgcgtgcctgcctttcctggccgccttctacctgagcctccaggcttggcatctgggccgtgtgggctgctgggccctgcncttcctgctggacctcagccgcagcgtggggatggccttcctggccgccgtggctttggaccggtacctccgtgtggtccaccctcggcttaaggtcaacctgctgtctcctcaggcggccctgggggtctcgggcctcgtctggctcctgatggtcgccctcacctgcccgggcttgctcatctctgaggccgcccagaactccaccaggtgccacagtttctactccagggcagacggctccttcagcatcatctggcaggaagcactctcctgccttcagtttgtcctcccctttggcctcatcgtgttctgcaatgcaggcatcatcagggctctccagaaaagactccgggagcctgagaaacagcccaagcttcagcgggcccaggcactggtcaccttggtggtggtgctgtttgctctgtgctttctgccctgcttcctggccagagtcctgatgcacatcttccagaatctggggagctgcagggccctttgtgcagtggctcatacctcggatgtcacgggcagcctcacctacctgcacagtgtnntcaaccccgtggtatactgcttctccagccccaccttcaggagctcctatcggagggtcttccacaccctccgaggcaaagggcaggcagcagagcccccagatttcaaccccagagactcctattcctga

SEQ ID NO: 31823 - DNA, 5839 bp, Homo sapiens
accccacatcacaaccacgacgggttgtccgcagctcgcagccaccccaaagggaggaataaagaacaggagcagagggaagccgggcgcagaaagaagggaaaaggaagagctcagggttggacatttttggagacagggtggggaggataaagggagcgtgcctccttgattttcccctccccacccctctttgcttttctctccccttctctgtatagcatattccagaaacgacagcagaaggggacagaaacctctagtgtagaaaagggttttggaggggtagccagcgctcccgccagccgctacctaacagctggagcttgagtgtgcgtgtaagagtgtgaatgcggctctctctctttttttctctctctctcccctctctctccatcccttccttcctccctccttctccctctccttcacactacagtgtcagctacccctgtcagtttccccgtgtcagtttcttccctagctgttattgtgtgtgactggctgcgtaaagggagtgggtgcgcttgaaggggctcaggttgggttagagagctgggagaacagggtagggacattggtagagcaaagagtttcagggcactggcgaaggtgaaaggtgaggagggccgatctgttacaggcaagtttggcaataactgagcatccaaaggggaagccaaggtaggagccagtacttgcgctcgtctttacaccccgcccctttccctgtgctcatccgcccacccacccatcagcctagaggccccgggctgtcccagtcggctgctgtttcgcgccgcaaaagaggagtccggcaaggcgccgcaccacgcatcctggccggtggacatccagacgacacagattttatccaaaaaaaccacttggctcaggatttctgcattgctatgaaccatggcccaactgtactacaaaaaggtcaactactcaccgtacagagaccgcatccccctgcaaattgtgagggctgagacagagctctctgcagaggagaaggccttcctcaatgctgtggagaagggggactatgccactgtgaagcaggcccttcaggaggctgagatctactataatgttaacatcaactgcatggaccccttgggccggagtgccctgctcattgccattgagaacgagaacctggagatcatggagctactgctgaaccacagcgtgtatgtgggtgatgcattgctctatgccatacgcaaggaagtggtgggcgctgtggagcttctgctcagctacaggcggcccagcggagagaagcaggtccccactctgatgatggacacgcagttctctgaattcacaccggacatcactcccatcatgctggctgcccacaccaacaactacgaaatcatcaaattgcttgtccaaaaacgggtcactatcccacggccccaccagatccgctgcaactgtgtggagtgtgtgtctagttcagaggtagacagcctgcgccactctcgctcccgactgaacatctataaggctctggcaagcccctcactcattgccttatcaagtgaggaccccatcctaactgccttccgtctgggctgggagctcaaggagctcagcaaggtggagaatgagttcaaggccgagtatgaggagctctctcagcagtgcaagctctttgccaaagacctgctggaccaagctcggagctccagggaactggagatcatcctcaaccatcgagatgaccacagtgaagagcttgaccctcagaagtaccatgacctggccaagttgaaggtggcaatcaaataccaccagaaagagtttgttgctcagcccaactgccaacagttgcttgccaccctgtggtatgatggcttccctggatggcggcggaaacactgggtagtcaagcttctaacctgcatgaccattgggttcctgtttcccatgctgtctatagcctacctgatctcacccaggagcaaccttgggctgttcatcaagaaaccctttatcaagtttatctgccacacagcatcctatttgaccttcctctttatgcttctcctggcttctcagcacattgtcaggacagaccttcatgtacaggggcctcccccaactgtcgtggaatggatgatattgccttgggttctaggtttcatttggggtgagattaaggaaatgtgggatggtggatttactgaatacatccatgactggtggaacctgatggattttgcaatgaactccctctacctggcaactatttccctgaagattgtggcctatgtcaagtataatggttctcgtccaagggaggaatgggaaatgtggcacccgactctgattgcggaagcactcttcgcaatatccaacattttaagttcgttgcgtctcatatccctgttcacagccaactcccacttaggacctctgcagatctctttgggacgcatgctgcttgatatcctcaaattcctctttatctactgcctggtactactagcttttgccaatggactgaaccagctttacttctattatgaaaccagagctatcgatgagcctaacaactgcaaggggatccgatgtgagaaacagaacaatgccttctccacgctctttgagactcttcagtcactcttctggtctgtatttggccttttaaatctatatgtcaccaatgtgaaagccagacacgaattcaccgagtttgtaggagctaccatgtttggaacatacaatgtcatctccctggtagtgctgctgaacatgctgattgctatgatgaacaactcctatcagcttattgccgatcatgctgatatcgagtggaagtttgcaaggacgaagctctggatgagttactttgatgaaggtggcaccttgccacctcctttcaacatcatccccagccccaagtcatttctataccttggtaactggttcaacaacaccttctgccccaaaagagaccctgacggtagacggagaaggcgcaacttgagaagtttcacagaacgcaatgctgacagcctgatacaaaatcaacattatcaggaagttatcaggaatttagtcaaaagatatgtggctgctatgataagaaattccaaaacacatgagggacttacagaagaaaattttaaggaattaaagcaagacatctccagctttcggtatgaagtgcttgacctcttgggaaatagaaaacatccaaggagcttttccactagcagcactgaactgtctcagagagacgataataatgatggcagtggtggggctcgggccaaatccaagagtgtctcttttaatttaggctgcaagaaaaagacttgccatgggccacctctcatcagaaccatgccaaggtccagtggtgcccaaggaaagtcaaaagctgagtcatcaagcaaacgctccttcatgggtccttctctcaagaaactgggtctcctattctccaaatttaatggtcatatgtctgaacccagttcagagccaatgtacacaatttctgatggaattgttcagcagcactgtatgtggcaggacatcagatattctcagatggagaaagggaaagcagaggcctgttctcaaagtgaaattaacctcagtgaggtagaattaggtgaagtccagggcgctgctcagagcagtgaatgccctctagcctgttccagctctcttcactgtgcatccagcatctgctcctcaaattctaaacttttagactcctcagaggatgtatttgaaacttggggagaggcttgtgacttgctcatgcacaaatggggtgatggacaggaagaacaagttacaactcgcctctaagtcaagccctaatcatctgttctggaactcaacagaaatctgtaatttccttgctctcagaggtgacacagaatatgattccctcactgcccctgccccccagaaaggagagtgaaactcttatttgcaccatcttttatagccacattctccatttttgttcttgttttattattactttcattattatttgcctttttaatacctatacacactaagtccatcttacaaccgactgaaggggtgttgcacctaatcatcagaggtgcagttgggtgcttaacctttttgctttgcttttctcacccatgcttccttgaagccccaggtgccactttgctggtcttgttgccgcacagattcctgaccatcctcagaatctcatgccattttcccgcagagctgagggatgtggtcagcagtccccaccagctatcagataaggcaaactaccctgcccatctttgttgccattcagtgctacgcgctgcccatgctgggtcaatgaacagcatcaaagggaggctgaagagatttcaaagaattgtcagcttgtggtttctgggtataagtggcttgtttcgttcttaaatactacaacttcttattgtgggggctattgagttttcttgtttcttaaagatgtgttagtttcctaatgtgtgccaatgaaatatttaccccatagtatatgtcatatctaataagttaggcgaattatttttctgtttgtgtgtttcagttaacttactacattcgaaaatttgatagtatcaaaattagtatttagaatttgtgctattttttaaaaacatctactacactctaaccaatagtcactacatctcatacattggcaagataaatagttgtcatatttgttgggtcctattctactgttgatagttttaattatcattgctatcaaataatttctaagataaaagcctgaatttgaaatatttttatcagaaaaatggcatattgctgaagtgtcaaaatatgagaaaagagcatcttcattttaattaactgctttataaaaatggcaactttaggtatagataacctaattcaggttgcagttttaatattcattgggggcagtggaattgcatgtgtaaattatgttagatatatatcataacaaccctagtggattcatggaattataaacgtgatccaaattctactgtcttccaagaaagctacatttatacatccaaacaaattcttttccacagcttaagagtacctcatcagaatacagtggttcaagttaaaaaataaagtccataatgcatatggtcatcattctagacctgataaccactgagaacctgctgagcaaggacggcttttaccaacattagcacaaaggtttcctcagtttagactctaacatatgacctgaaacaactctaggtctgagtcctagagattacataaatagtgtgtagcccagaaaagtaaaataggtgtcacgctgttttttttaatgtcaacaccaataggaatccatttagattaatgtatgtaatttctgataaaagtaagagaaatgaggaactttcgaactgcaaatatgcctccaaactagcttttgataagtgtggtttctgttatttgaatggattcccatctttgtctctagcctggagaagagcaaaatggagggggaggggccagaaataggaggaggttttgaagaataaagcctcatatccaggaaaaagtgatcaagtgaaaaagctgcatcaagacccatttggcaagaggttgtccgaaaataattccttgatcatatctgaagtggttatttactcaaatcaatttctcccctgcgtcgctaagactgtcataaaatggccttgacatttaatcacaggttactttccagaaaggtttctaaagttacagattcagcttttcaaattgtcaaattcactttgaataataatagaacctgggctacattcctaactcatattaacagcac

SEQ ID NO: 31824 - DNA, 964 bp, Homo sapiens
acttaggggtggccgtcatgctggggctaaacccacctccatgtctgaattcatcctcgtcggcttctctgccttcccccacctccaactgatgctcttcctgctgttcctgctgatgtacctgttcacgctgctgggcaacctgctcatcatggccaccgtctggagcgagcgcagcctccacacgcccatgtacctcttcctgtgcgtcctctcagtctccgagatcctctacaccgtggccatcatcccgcgcatgctggccgacctgctgtccacccagcgctccatcgccttcctggcctgtgccagtcagatgttcttctccttcagcttcggcttcacccactccttcctgctcaccgtcatgggctacgaccgctacgtggccatctgccaccccctgcgctacaacgtgctcatgagcccacggggctgcgcctgcctggtgggctgctcctgggctggtggctcggtcatggggatggtggtgacctcggccattttccaactgactttctgtggattccatgagatccagcattttttatgtcatgtgccacctctgttgaagttggcctgtggaaataatgtaccagctgtggccctgggcgtgggcttggtatgtatcatggcactgctgggctgttttctcctcatcctcctctcctatgccttcatcgtggccgacatcttgaagatcccttctgctgaaggtcggaacaaggccttctccacctgtgcctctcaccttattgtggtcattgtgcactatggctttgcctctgtcatctacctcaagcccaaaggtccccactctcaggagggtgacaccctgatggccaccacctacgcagtcctcacgcccttcctcagccccatcatcttcagcctcaggaacaaagaactgaaggttgccatgaagaggaccttcctcagcacactctattcctcaggcacctga

SEQ ID NO: 31825 - DNA, 516 bp, Homo sapiens
gaggtgctcctagcgtctagtgagcagcggccaggcatgctgttaaactccttgcaactggaggacacaataaataattatttcacagccatagtaaagaatgaaattggccggtcgcggtggctcacgcctgttatcccaccactttgggaggccgaggtgggcagatcacctgaggtcaggagtttgagaccagcctggccaatgtggtgaaaccccgtctctactaaaaatatcaaaattagccaggcatggtagcacgtgcctgtaatcccagctactcaggaggctgaggcaggagaatcgcttgaacctgggaggcggaggttgcagtgagccaagatcatgccattgcattccagcctgagcgacaagagaaaaactccatctcaaaaaaaaaaaaaaaaaaaaaatgaaatcatgtcctttgcaacaacgtggatgaagctggaggccattatcctaagtgaactaactcaaacatagaaaaccaaatatttggctgggtgtgacagc

SEQ ID NO: 31826 - DNA, 539 bp, Homo sapiens
ccttctatgctcatatcattcttcagtttttcctttttaaatgttttgctcagcctcttggtagcctcatctgttattatcacctcaggtagctgccacattaaataattgccactgactgttttcaacaaatagtttagcaaaaggctatttgtacagagtaaagtctgagtcatatcaaagacaagctgtgagacaggtcaaacagtgaaagttttctggagatggaacttctccccttcagtagctgctaggctgcttacattcaggactaccataattgtgaggctgttagttttcaatattactacagaactggagagagtggaatgggactagggcaagttaaaacatcacaacacttattattcttaccaagattcagccacctttcttgaatcaacactcttcaagttactgaaaacctttgattaattttcagagttctgaaaaagttgcttttaactatttttccagtactcttattgcttttatgaggaagtggtatgtattttttttaatgtcctcactctaccatt

SEQ ID NO: 31827 - DNA, 401 bp, Homo sapiens
tgataagctgctggtggaataagataaattttaaatgactaggctcttgcatcagaatttgaatgtcaagaaatgaattgtcacaaagcaacaatagattcctggtttgttttacacaaaaacaacctctttccaggtttttagattacttctcagactgtgttactacgggtcagaaaaaaggtaagagaaaaaaatttgccaatactcctaatcggtgactttgaggatttaagaacaaactccaaaaactattccctgagacggaaagttacgctgattctcatcctaaaaaataaggaatgtggcacaaatttaaaagataagagggaaaaaatcaccaacattcaaatagagagattcagttcaattagatattttaagaactatagcagaccatc

SEQ ID NO: 31828 - DNA, 861 bp, Homo sapiens
tcttactgaaactgaaaattgcaaaacaaagaattttctagttctcacattccttgatggagaacagtgtttatatagaggttatcttgtggtttattttatattctacttaactttaacatttctgcaggtagaataaatatcctatttaaagctttcaaatcttattaattaaaggtagttgtcattactaattgtttactgagttttatttatttttgcttcattgtagctcatgaggaggccacctaaattgatcagaatataagcttatcctagtcactgaaataatacttagtgccggcaacagaaatatactcaagaaatatttgttaagtgaataaactgataatgacctaggaggatgcaagtcttaaaaagtagttcagaatatgcagattttaccatcagtctgagagttggtaacttagaacattttctatttgagctagtatgaatttaattttttagaatgcgacgatgtcatcagttcttaagtaggcctgggaactcattctttttgaaatatattacattttagagactttataacaacattttcttccatttgcatgtattgacagttttttatgttctggctggtcacagtgggctcatgcctgtaatcccagcactttgggaggctgggatcacctgaggtcaggagtttgagaccagcctggccaacattgagaaacccccgtctctactaaaaatacaaaaattagctgggggtgatggcacatgcttgtaatcccagttactggggaggttgaggcaccagaatgtcttgaacccgggaggcagaggttgcagtgagccaaagttgcgccactacactgcagcctgggcgacagagtg

SEQ ID NO: 31829 - DNA, 573 bp, Homo sapiens
atttggaaagggagagaagtcaaaactaaacacagaagagccttccattctgaaatgggacagaagtccccacagattctcactgacattccggtttctttttcccctgccttacatgcttatgatctccagttgacctccgctataaattgaagggattgaggcaaatggtttctaacattcctttgggctctaaagtttgtagttttcaaatggagaaccaaggtgtaactgccaaggaggcaggtagggacagagcctaggcccagggctctggtctgtgctggcagccagaagaatggccgagggccaccatcttgcagtagcatagtagggtgtggccatgtatatggtaaatacaattaggattttgtctgttgcccagttttctagggtttttttcactgctcgtgctaattttcttaatagcaaaccatgctctgagcctttcccttcacagagggaggtgtgctggacgtacctccttctcaaggactggtgtgaatatgtatgatgcttctcaagctgcaaagaacacattacttgaataggtgcaaaaaaaaaaaaactatc

SEQ ID NO: 31830 - DNA, 737 bp, Homo sapiens
tcagtatttacctccaaattgctaaataacatgcttatattactttattgatttttcagttttaggcgttatttattgcccttctctggcatataaggatttcatttcttccttttcctatccccaccattcgtgttcacccttctcatctccccaagtgtattaagctgttttggggttgctataaaaaaatacctgcagctgggtaatttacaaagaaaagtggtttattttggcttaccgttctgcagactgtacaggaagcatggtgttgctatctgcttctggtgaggcctcagggaaacttcccaatcatgacagaagggcaaagggggaagcccagcatatcccatgatgagagggagcaagagatgggggaggtgccacactcctttaagcaaccatatctgctgtgaactcagtgcaagaactcatgtatcacttcatgaagagcaccaagccattcctccccatgaccaccacctcccaccaggcaccccctccaacactggagattgcatttcaacatgagatctggaggggacaaacgttcaaaccatgtcgccatatttccaacttagttcaattataattttggttggctgcatagttcacaatagttgttttctctttctgcccaactttttattttccctatactaaatttgtcttattttttctttaataattcaatcacaaaagatgtttggatatattgggttgtctatcagttactt

SEQ ID NO: 31831 - DNA, 3868 bp, Homo sapiens
  misc_feature (629)..(629): n is a, c, g, or t
  misc_feature (1142)..(1142): n is a, c, g, or t
  misc_feature (1567)..(1567): n is a, c, g, or t
gtaggaagtatatgggtagggtcagataatatttctgaaaggaaacacccaggagtatcccaagttaatgacattttagaccctccaacaaccacacaagtcagctccttggaaagactctggttacttttacaaagcaaaccaggagaattttcataatacctgataactatgtaagacttggaatatttgaatttctaggacatgggattgtgcaaccattcattttatcccataatattgaaatctccctcagataagcctctcggcacctaatagagttttcttagtgaagggctacctttctgtgggtaacagggaagggcaaaataaacaaccaaataatatcataatcacgagtgtcaatgattgctggaacaggtgggggttggtcattaaattctagttgtttccactattccagtaggagttgtgtgaatgttagcaaaagaccagggtgttacgatctgactgtgtttcatcaattgccttgacttttggatgaaatgcgatttgaggacatatcattattagatttgccacagattccaatttttttctctaatatgaggctaaccatgatgtcctttcccaggaaggacaatctctcctttatcagggaaaaatcngtaggggcttcctcaattttctccttcatccccaccacagagtcatagaggtcaagtccttttcttgtgaaacctaaaaaatgcaaattccaaggttgctgctatggtgtactaattttgtcacagtgacatgccctgtcacagggcgtatgtgttctgttatacagttgaaatattggttatactattgaaatgtttttgtactattgaaatctcaaataaacttaattctaaaagaagcatgacctcaacagcctcacacctacttatatcttgtagttctttctgtctaatgctggcaatctaagcatgttccaggcaagcaacattcaatagcgttttactgctccaataagttggttcaattagcaatgtcaaaggcagtcactaaatagatagtgtataaccttcatacaatctcgtattattttccactaattactatagaaaaatcgatgaagtttcattacaatggaataacttcaatcacacttcaaaaactacatacggaanatagccacaacttgctgctctcaaaaaacacagagatggcatctttactttgtttcaaatccccaaccctggtggcggtccaaagttatggcagttataaccccttatgtcattataaggaggaagggtaaatattaagtcaacatcctttaaagctaagagtatgactacagtggggtggaatttgggacttcatgcccactccctgtttctgttctattttacctttcctgacctctaagccaacaggagagggggaagggccacacttttgtgacccttgttaaagaattgtgagtttaggaaacaaagatggacttctgagggggtagttgaggatgggctgaaggcacagaagaaaccagctggtgtgcccctctccccactagcagacccttcttcctcattggttcagggcaaacaancccccaaaaattcaagaaaactaacttagagttattttctgttatttctcttttccttgatctggagccaatgcagaaagaaatctaaaggtgaaggaaaggcagcgttcagcactgagcaagtccatgttggagaaagttcacagggaattggaaatccttgtcttcgtggttcctggctcagcaggacccctgtggggcctctccctctcttgggaaagagattgctctagaaggtttactacaccagtgaggagaagatgagcgcaagggggattggccggctgagggcgaaatcaagactggagccaagtgcgctgagctctcacatgaggtcctttgctcctgttccctggaggcataagtggctggggtagagagaagcaggggtatttcttctgtcctttcttgcttagggattgggggtggaaatctccccgcatctaaggaaatttgaaaagacaaactatggctgcttcttcaagcaaaccacctcaccacactatccaggggataaaacccgcttgctgctgctaaattatgccaagagagaacattctgatatttctcctcaattctaggcatgacagcgtgacttggtgcttaaaggcatggagttttgagttgcagacctaggtttgagtgctgaatctactagcttcagggtgttaaaaaagtttcttaatctctctaaaccttatttttctcaaagataaaaaactgggtgtagttgtgagtatagtgaatgcacatagtatgtgcctttggcatgttaattcactattattctggacataatttctcctaagaaaaaggatgaactaattgcagggcctagcctaagctctgagaagtcattcgttatagcatttcagtccatagtaaacaagaagaaatgaggtaaagagtttaaaccagggaaggcatagctgtggtcaccaaacaacctgttaaaggcgagctgtaggcaccaaaaaacctattatggactgaattgtgttcctcaaattcatatgttgaagtgctaaccccaagtaccaaatgtgactgtatttggggatagggtccctgaagaagtcactcagctggaaggagtcatattggattaggtgttgggaattggctggccaagggagaaatcaaggctggaaccaagtgctgaactctcacatcaggtcctttgctcctgttccctggaccctaatccaatatgactggcatctttatatgaagaggaagaggcaccagagggtacacacgcagagaaaaggccatgtgtggacacagtaagatgacggacatctgtaagccaaggagggaaacctcagaagaaaccagccttgcctgcaccttgatcttggaggtccagtctccagaactgtgaaaaaaatgaactggtgttgtttaaatcccccagtcgtggtattttgtcatggtggccctagaagacaatatacaacccaaaggaatattctttccactttctccctcttccactttatagttttttctccttcgtttctttctttttctcttttactttccttttcttctcttctctttcctctggtttttaattttaattttaatttttggccttcctatacctccatttgcctctccaggaagctgaattccagacaattaatcattcatctcatcagttcagcaaagcaaatgccctcaatggtttcttttgtgattcgattattatgggatcagaatgtatcttattcctctgggaaaaatgaaacataaaaatttcagaaataaggttttgggccagcttcattggttttaagagaaggaagggaggagactcatgcaggtttgacgctgagcagcaccatgtggttgggcctggcaggcactcgaggctttaggtcttggtttgaatccagactagaaaatcattacttattaaaagccttgaggatatgggtctaggaaagtctatgtgaagagataatagtttggaaaaagttttgcagaactaaagaaaagtttccacagttaccttttctgtcctaatgtagagcatctttgttaactaggtcttggatcaatccaagctgtgtctgagaataaccatttataatttctcactggccagcactaacaccctttagaaaaggaactcaaagcagccctagcagccagagtcatgcgatcatggtgggagtacagctcctcaccaaggtcagctcctcagtgaaatccatgccttctggaggactgcttgtaaataaatattaagcacaaccattaaaaaataatttggctgtgaccatcaaatagtga

SEQ ID NO: 31832 - DNA, 2569 bp, Homo sapiens
  misc_feature (203)..(203): n is a, c, g, or t
  misc_feature (267)..(267): n is a, c, g, or t
cattcttcaaaagtttcactgacatgaacctcacttgtgggtgccaggttatgaccacatgcatagtttcatcttcatcttatgcaacatttggggtaaaaggaaggttatgtggtaaccagtttatgacttgaactataggcaaagattgaccagaccaagccctgagacacagtgttgagagccaagacataaagttgtgnagattcagacccagagcccagcagggcacaggctggaggggtgatgtgagtgatcagtaacacnatgaagactctgctcctggatcaggaatgcttttttgtccctgtttttggattttccaccatgatcagccaatgcagaaagaaatctaaaggtgaaggaaaggcagcgttcagcactgagcaagtccatgttggagaaagttcacagggaattggaaatccttgtcttcgtggttcctggctcagcaggacccctgtggggcctctccctctcttgggaaagagattgctctagaaggtttactacaccagtgaggagaagatgagcgcaagggggattggccggctgagggcgaaatcaagactggagccaagtgcgctgagctctcacatgaggtcctttgctcctgttccctggaggcataagtggctggggtagagagaagcaggggtatttcttctgtcctttcttgcttagggattgggggtggaaatctccccgcatctaaggaaatttgaaaagacaaactatggctgcttcttcaagcaaaccacctcaccacactatccaggggataaaacccgcttgctgctgctaaattatgccaagagagaacattctgatatttctcctcaattctaggcatgacagcgtgacttggtgcttaaaggcatggagttttgagttgcagacctaggtttgagtgctgaatctactagcttcagggtgttaaaaaagtttcttaatctctctaaaccttatttttctcaaagataaaaaactgggtgtagttgtgagtatagtgaatgcacatagtatgtgcctttggcatgttaattcactattattctggacataatttctcctaagaaaaaggatgaactaattgcagggcctagcctaagctctgagaagtcattcgttatagcatttcagtccatagtaaacaagaagaaatgaggtaaagagtttaaaccagggaaggcatagctgtggtcaccaaacaacctgttaaaggcgagctgtaggcaccaaaaaacctattatggactgaattgtgttcctcaaattcatatgttgaagtgctaaccccaagtaccaaatgtgactgtatttggggatagggtccctgaagaagtcactcagctggaaggagtcatattggattaggtgttgggaattggctggccaagggagaaatcaaggctggaaccaagtgctgaactctcacatcaggtcctttgctcctgttccctggaccctaatccaatatgactggcatctttatatgaagaggaagaggcaccagagggtacacacgcagagaaaaggccatgtgtggacacagtaagatgacggacatctgtaagccaaggagggaaacctcagaagaaaccagccttgcctgcaccttgatcttggaggtccagtctccagaactgtgaaaaaaatgaactggtgttgtttaaatcccccagtcgtggtattttgtcatggtggccctagaagacaatatacaacccaaaggaatattctttccactttctccctcttccactttatagttttttctccttcgtttctttctttttctcttttactttccttttcttctcttctctttcctctggtttttaattttaattttaatttttggccttcctatacctccatttgcctctccaggaagctgaattccagacaattaatcattcatctcatcagttcagcaaagcaaatgccctcaatggtttcttttgtgattcgattattatgggatcagaatgtatcttattcctctgggaaaaatgaaacataaaaatttcagaaataaggttttgggccagcttcattggttttaagagaaggaagggaggagactcatgcaggtttgacgctgagcagcaccatgtggttgggcctggcaggcactcgaggctttaggtcttggtttgaatccagactagaaaatcattacttattaaaagccttgaggatatgggtctaggaaagtctatgtgaagagataatagtttggaaaaagttttgcagaactaaagaaaagtttccacagttaccttttctgtcctaatgtagagcatctttgttaactaggtcttggatcaatccaagctgtgtctgagaataaccatttataatttctcactggccagcactaacaccctttagaaaaggaactcaaagcagccctagcagccagagtcatgcgatcatggtgggagtacagctcctcaccaaggtcagctcctcagtgaaatccatgccttctggaggactgcttgtaaataaatattaagcacaaccattaaaaaataatttggctgtgaccatcaaatagtga

SEQ ID NO: 31833 - DNA, 339 bp, Homo sapiens
gagttaaagtcctgtaatggttgtcagataagtggattgatgaaggaataaaaaaggaattcaaaaaccattacgtttatacttcaagaggttatttttaatcaggaatggattcaagtaaaatattctaagtaatttttgaagaatgagtaagttactcaatttaaaaaaataaagggggcaaaagaaaaaatcaaatttgtcccaacagagttcagtgattttacaaaacaaatccattgatctagactctcccagttttgtctgccttttcctgtgatcacaggtcaagatgactgattaccctgggaaacacgctatagtctatctcataaacag

SEQ ID NO: 31834 - DNA, 827 bp, Homo sapiens
ataggacaacaggctcagacctgagcataacacttgaggtaatggtgcaggatacagagggttgccctccattcccctcttccagagcaccacaccctggggagacttcccttaccccactgatctgaccattcctgacctgcatccatctgtaatgtcgtggccatggggactggaagggggctgcgagcctgtgccggccagaaggcagtccagcccagcgcagctcagccagctgtcccaggcctctgcaagtcctgtgtgaaaatgaagctgtaaatatcttcctcaagagtcgtatgaggatcaagatcatgtactgaagtgcctggcacaggatcagtccttgactggtgccctgacttttggcagccaccaggtgacctcaagggccttacaagaggttgaagcctgctagtttctctcctgactgggaatttaggataatggctgaggggtgtgtctgtgaaagcctcgtggggaaggccatgagcttgggtgtgattgcagctgctaaggacccttctgtcccccttcagtagcttcctcttggcattgacttcaaaaacccagcaacctgggtgttctgccactgtggtattctgccattggcagctgtgcagccttcgataaggctgtgccctttctgggcatcagtgtcctctccagtaaaagggatcctgttgctccctccttctgtcctttggggttgcagagacaccctgcctggcattttgctttcactgaagggccctgcagagtctttgggctgccttagtcatcattcctgaggctcagcttagaggcttctgagtgtggcacatccc

SEQ ID NO: 31835 - DNA, 389 bp, Homo sapiens
aattctaaagatgacaagctcattctcacactaagtccgtagaaattatagtagaggtacttttgaattaataaaaatgtatatcactgctctcaaaaatagaagggggctgggcatggtggctcatgcctataatcccagcactttgggaggccaaggcaggtggatcatttgatgtcaggagttcaagaccagcctggccaacatggtgaaaccctgtctctactaaaaatacaaaaattagcctggcgtggtggcggacacctgtaattccagctactggggaggctgaggcaggaaaatcgcttgaatccaggaggtggaggttgcagtgagctgagattgcaccattgcactccagtctgggcaacagagcaagaccctgacta

SEQ ID NO: 31836 - DNA, 372 bp, Homo sapiens
  misc_feature (332)..(332): n is a, c, g, or t
  misc_feature (345)..(345): n is a, c, g, or t
  misc_feature (362)..(362): n is a, c, g, or t
aaggctatagtaatccaaacaacatgatactggtataaaagtagacacatagaccaatggaacagaatagagaaccgagaaataaagctgaatacttacaagtaattgatcttttgacagagcatacaaaaacataaatcagggaaaagacattctattcaatagatggtgctgggacaactggatagccacatgtagaagaatgaaatggacccctatctctcactatctacaaacatcagctcgagggggggcccgggtacccaattcgcccttttagttgagtcgtatttacatttcactgggccgttcgtttttacaacgtcgttgantgggggaaaaccnggggcgtttaccccaantttaattcgc

SEQ ID NO: 31837 - DNA, 570 bp, Homo sapiens
gttgtaagtaaggcaatgcctggtgatgggttcttggggctcctggagtttgatttaataacaaatatttattgaccacatattgtcttgtactgtgagaggccttatgggaggtcaaaaggaattttgccctaatgatcttaataatctccataggacaaaaagtgcacatgtataaagtggaaaacaaggaaagcctggcagatgatggttaaatttatttgctgatcaatgtgaatgaggcagactaagaggtttctaccagaaggaacttgagcttcttgattcgagttagccatcaagtaacttgaggtgaccttgggcaaggctttcttactggtctcctatattggacgagggcccctcaagcccaagtgagaaggctgtttctattatctccttttcctcctatctccagtgggacacccagtcctgcgaattctattttgggaatgtttctagagtctgcccagtctcttcccagtccagtgctttctccatcccgtggccagggtaatcttgctgaaacacaaatctgatcacgtcacccacctctgcttaaaaccttca

SEQ ID NO: 31838 - DNA, 2036 bp, Homo sapiens
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 31839 - DNA, 1831 bp, Homo sapiens
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagcaccctagtttcattctcaactctagccctgcacactcacctatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagtgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcatatttggttattttcaatgtgacga

SEQ ID NO: 31840 - DNA, 325 bp, Homo sapiens
tggcctcccccaactctagaattcctgagagaggggaggggacagccctccccgccctcaccccgccctggggctgctctctcggcaggaccaggcggtccagcgaaggagtcgactccagcgaaggcagagctttgcggtgctccgtggggctgtcctgggacgtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 31841 - DNA, 2831 bp, Homo sapiens
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 31842 - DNA, 2707 bp, Homo sapiens
tggcctcccccaactctagaattcctgagagaggggaggggacagccctccccgccctcaccccgccctggggctgctctctcggcaggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 31843 - DNA, 2203 bp, Homo sapiens
taggctagtagggctggggttaatcggcgaggccaggtgtcttatatggagacggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 31844 - DNA, 2729 bp, Homo sapiens
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagtgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 31845 - DNA, 2684 bp, Homo sapiens
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 31846 - DNA, 3153 bp, Homo sapiens
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcataaaaaaaaaaaaaaaactccggggacactaatgacgggggcgaaacaacgggtagcaatgcgcagtgccctagatggttcgtgacccacagtttttggggaccacggggcgaacctcgcggggccccaaaagggaggcgagaaattccgaaccggtggaacacacgtagaactagaatagcagagagcaagaagccaactcacaagcacgaacacaatacagcagaagcagcagacacagacaaagcacaagagaacacacatcccgagcaacagaaagaacagaatcaagccaacacacacaacaacagagcaagacgcggg

SEQ ID NO: 31847 - DNA, 1625 bp, Homo sapiens
taggctagtacgaggccgggtggtaatcggccgagggacacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 31848 - DNA, 1989 bp, Homo sapiens
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagcaccctagtttcattctcaactctagccctgcacactcacctatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 31849 - DNA, 2854 bp, Homo sapiens
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcatatttggttattttcaatgtgacga

SEQ ID NO: 31850 - DNA, 1089 bp, Homo sapiens
  misc_feature (57)..(57): n is a, c, g, or t
  misc_feature (61)..(61): n is a, c, g, or t
  misc_feature (85)..(85): n is a, c, g, or t
aaactatggggtgttccaggtatagaatcgtatgtttgcaaacagagatagtttgantttntcccttccagtttggatgcctttnatgtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 31851 - DNA, 2062 bp, Homo sapiens
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 31852 - DNA, 1960 bp, Homo sapiens
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagtgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 31853 - DNA, 1796 bp, Homo sapiens
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacccgtcggggggggccccgctcccaattcgcccttatttgagtttgattacaaaaaattggcccgttttttacaaactttttgcctgggaaaaccctggggtttacgcaacatattggaatttggaccaatatcctctttt

SEQ ID NO: 31854 - DNA, 922 bp, Homo sapiens
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcaggttcgagcagggagaggaaaggaggggcaaagaggtgagggacaggggggacaatggctttccctctgtcccctgccagctcccccagctgcaccctgggcctggtcttgcccctctggagtgacacccaggtgtacttagatggagacgggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 31855 - DNA, 934 bp, Homo sapiens
ataagtagttactaaattactttacctaattatgtaataaatggaatcattaggtatttcctttgccgtagggtcctgtgaacaaattactaagatactaagggttctgtgaatgagtttaagatcctctaactgtagatatgatcagtgtttatctatattatcaattttttttaagaacttgatttttagtggatgtttatactcttatatgaatatgcaatgctttactgaactctctctgcttgttgaacatttaagtttttcctaatattttgataatatgtgtaatactaatagctgttgttgtgtctaaatcttggtccttaatatctaattctttccttaaaatagcgtcttataagttaatttgctgtgtcaaagggtattagttgtttaaggctcttagtatttataacctaattttttcatatatagttttctccactactactaacaatatataaaaagtgcccctcatctcaacctcagtggctgtgaatgttctttatcacaatttgacagttgaaatggtttctgctttagcatgatagtaattagagctgtttctctatgattttcctacatctgagctaaagatcttaccagtcttacaatttacatctttcttagctcctaggacctgtagttcatggttgaggtaccacccctcttccaacctcactagtctttacccattttatagttggtaattatttttgacttactaaaaagcagctaatttttgtagtttttgtagagatgggggtgtcaccatgttgtgttggctggtctcaaactcctgagctcaaacagtccacccacctcagcctcccaaagtgctaggattacaagcatgtgccaccactcccagcctgtatttttatttatttatttgtttgtttgtttgtttgacagagtgagacgcgtctca

SEQ ID NO: 31856 - DNA, 173 bp, Homo sapiens
gtgtgtcaacaaaattaagagagtttgggttattgaagatacaagagtgtttttgaaggtatatataggaaaccaaatctcaaatgtggtctgtccttgtgattaaaattagagcaatagggaagccaggtgtgatggctcacacctgtaattccagcacttttgcaggctgt

SEQ ID NO: 31857 - DNA, 335 bp, Homo sapiens
ccccaccagtcacaaggctactttggaaaagtctggcaggtcctcaaaagttttaatgtaaaatttccatatgactcagcagttccactcctaaatagatatatacccaagagaagtgaaaacatactggccgggcataatggctcatgccggtaatcccagcactttgggaggccgaggcaggcggatcacgaggtcaggagttcgagaccagcctgaccaacatggtgaaaccccgtctctactaaaaatacaaaaattagctgggcgtgatggcgcgccactgtaatcccagctactcgggaggctgaggcaggagaatcgcttgaacctgg

SEQ ID NO: 31858 - DNA, 362 bp, Homo sapiens
aaattaaggggaagtttcaataaaaaagatgatgtcccaaagaaagtgaatggagaaaacttcatagtaaggacaatcttgaatatattgcacaacattgaaacaaaaaaaattaaatgttggaaacggatccaaatttagaaagagtatgataactggccaagttataaaaaggattctcatttcatattgtgcattataaaatgagaaggcaaacaatgttcaaattactcttgataagattttttcaaagaaacaaaacaattatcaatgtttctaatattgtatataactgtgtaaaataaatatttggttatttttgaattttccccttatatttatcaccaacaataagagaattt

SEQ ID NO: 31859 - DNA, 501 bp, Homo sapiens
tcaagagcatgggctttggggtctgaaccagatttgagacttggatccattacttcctgccttgtcaacttggaccaattacttcatctctctatacctcagtttccttgtctataaactggagacaacaatacctactttgtaagacctttgcaaggatttaaatttagcaggataatgcatgtaaaatgattagcatgttgtctggcatagaaatgtttgatgattggaaacatttactcttggccaggcatggtggctcacgcctataatcccagcactttgggaggctgaggcgggtggatcacttgaggtcagcagtttgagaccagcctggccaacttggcgaaaccccgtctctactaaaaatacaaaaattagccgggcatggtagcacacgcctgtaatcccagctactagggaggctgaggcaggacaattgcttgaacccgggaggcagaggttgcagtgagccaagatcacgccacagcactccatctc

SEQ ID NO: 31860 - DNA, 1741 bp, Homo sapiens
ggaaaagtctgttttttttgaaatacctttttttttctatttattcctttaattattatacattagaaagaaatgacaaggattgcatcctagttttaaaatgctgaacttttaaaaaggcaattttatttttaagactttaaataactcttattagtaattggatttgtggcagattccaagagggtggttttggaaagcacagtggcttcccggtggcttcagaccttggtttggaattgcaggcctaccgcacaccgactctggagagtgacttggagcctccaaattccaagcttcctgtgtgcgagtgaggctagcaaaccacattgagtaggacagcctgagggttaagttacaccatggatgaaaagctgatgcatggttctaacttgcccgggcttgatattcaaaagatgtctattccttttccattttctctcttttccaaaaatcctcttgctctgtttctgttaagacccttttgcaacactctgttttaacatggtgcttaatatattgtcagaaaccacattttccagtgcatatggtgcagtttttaatttctaatttagctttttaattaaaaactcaccttttgctcctaatacctataggggttggtttccaattctgcttttctggtggtaactgaatctctgttctcccagtgatgagtgtaaccctctgtgtacaagtaggaacatcatgactgccatgcttgggccattggtataattatttctgctacctctgaagactgtggtgagggtagaatcagagtggtccctagccatcgtcccccttttgaattggtagtcatcttgaatgtcacagcagcctagacttgtagaccatatcaggaaagtagaagcaagaattctgtcgtgtgctactccactccaagatgctgtaggtcatcagaagctctgtgacttcagatgtgcaagtgaggccaaggcactgtcacattaatatctgtgtgatctcggtggcattgtgcttttccatcattgtcagggctgctgggctctctgtgcctaaaagctgcttcaaacaagcagctcacattccagagctctgagagatgttgtcagcctttaacagttttctcttcgagaagacattagattctgtacaggttgcagaaacgttgtcttaaggtggctggaaggaagtgtttgaaataacacatgtgcttgtgattttggtaaccaaggaaacatgtacctgatacaaagcttcctttaaaaaatgatggtacccttctgggattgcctcagaatcacccacagcaagattccaaagggatttaaaattaaagtaggtcacttccagcaactgtatcaagagttaacagagaatcacctctttaaaaatgaagaatcatctctttaaaaatgtactgtttagaagaggaacccaatacattgtggatacaatatgctaccatctgaataatctgagtcttgcttataatggatgtttaataagtcttacctggattaaattttcctctgcttctgccttattatttgtattatttttattcttagtttgccttctattccaaattaatccttagcttctcgccatctcttttctaacagtttgttattaaaattatatagtgatggttaatgcagccactacctgtactttgcaaacagattttgctaatacatccatgatatgtagaatgatagaaactggagttgacttagaagataatcatatccaa

SEQ ID NO: 31861 - DNA, 476 bp, Homo sapiens
ttttcgaatacttaagagggcccctaaagtgtccagaaaagagaggtaaacaggattatttggcatgtttaggtacatgggattgccaaaatgatgctcagtcttctttaggttatatcttggtgaataatgctaatatatattccaaaattgcatgggatttctaaaattctaatgtctgagtatatgctatcaatcacaattaaggtttttatgttaagttattgtaaaccacagggataaccaagcttctttgtcaattgtgtttctaattttaactaccctggacattttgctattcacagacaattgttgtcttgttttaattcttttcaaaagatggtttataatagggtataagactctgataagtgctttcagatacaatttctgattttatttgagacaatcaggtttctgataactttgcagattgtaacattggaataaaggaaaatgtacaagactcatgaaga

SEQ ID NO: 31862 - DNA, 3669 bp, Homo sapiens
  misc_feature (2321)..(2321): n is a, c, g, or t
  misc_feature (3143)..(3143): n is a, c, g, or t
  misc_feature (3156)..(3156): n is a, c, g, or t
  misc_feature (3185)..(3185): n is a, c, g, or t
  misc_feature (3319)..(3319): n is a, c, g, or t
  misc_feature (3378)..(3378): n is a, c, g, or t
  misc_feature (3384)..(3384): n is a, c, g, or t
  misc_feature (3390)..(3390): n is a, c, g, or t
  misc_feature (3460)..(3460): n is a, c, g, or t
aggacagtacagtgccttacttgcaagatgtgcaagcacacaagacctatgaagaactgtctcccaacaaaggatacatgcagaaggagaaaaaactctcttaaacaaaaagaggcagagccggcagggaccgagcgggtgcctcagtctccttcccctcccctcgcctgtcctcgccatcttcttctcacagccggaccggaactatgtgatcccggaagttccgggtcctttggccctatatgatcccggaagttccggggcttttggacctctgtgattccggaagttccggggcgttccggggcgttctggggcctttggagcgtgggataagcagtaatggcggaggctgcagctcccggaacaacagtcacaacatcgggagcaggagcagcagcggcggaggcggcggagacggcggaagcagtctccccgactccgatccccacagtcaccgccccgtccccgagggcgggcggaggggtcggcggcagcgacggcagcgacggtagtggcggcaggggcgacagtggcgcgtatgacggcagcggtgcgtgcggcggcagcgacgcgtgcgatggcagcggcgacagcagcggcgacagctggactaaacaggtcacttgtagatattttaagtatgggatttgtaaggaaggagataactgtcgctactcgcatgacctctctgaccgtctgtgtggtgtagtgtgcaagtattttcagcgagggtgctgtgtttatggagaccgctgcagatgtgaacatagcaagccattgaaacaggaagaagcaactgctacagagctaactacaaagtcatcccttgctgcttcctcaagtctctcatcaatagttggaccacttgttgaaatgaatacaaacgaagctgagtcaagaaattcaaattttgcaactgtagtagcaggttcagaggactgggcgaatgccattgagtttgttcctgggcaaccctactgtggccgtactgtgccttcctgcactgaagcacccctgcagggctcagtgaccaaggaagaatcagaggaagagcaaaccgccgtggaaacaaagaagcagctgtgcccctatgctgcagtgggacagtgccgatatggggagaactgtgtgtatctccacggagatttatgtgacatgtgtgggctgcaggtcctgcatccgatggatgctgcccagagatcacagcatatacaagcgtgcattgaagcccatgagaaagacatggagttctcatttgctgtgcagcgcagcaaggacaaggtgtgtgggatctgcatggaggtggtctatgagaaagccaaccccaacgagcaccgcttcgggatcctctccaactgcaaccacaccttctgtctcaagtgcattcgcaagtggaggagtgctaaggaatttgagagcaggatcgtcaagtcctgcccacaatgccgaatcacatctaactttgtcattccaagtgagtactgggtggaggagaaagaagagaagcagaaactcattcagaaatacaaggaggcaatgagcaacaaggcatgcaagtattttgatgaaggacgtgggagctgcccatttggagagaactgtttttacaagcatatgtaccctgatggccgcagagaggagccacagagacagcaagtgggaacatcaagcagaaacccaggccaacaaaggaaccacttctgggaattctttgaggaaggagcgaacagcaacccctttgacgatgaagaagaggctgtcacctttgagctgggtgagatgttgcttatgctttaggctgcaggtggggacgacaaactgacagactctgaaaatgagtgggacttgttttgtgatgaagaattttatgtcttagatctatagaaaccttgcgtagtgtgtgagctggtctgctgaccccagatagcagctgtcccctgtggtggtgtggcagtgcctatgttctctcctaggcagacctatcaactccaggtgctgcggttaagaatatgtacccagggcctgtcttgtcaacccctcacctttccccaaggagtgtgttgttttccctgttggaaaaagttacaaaaataaatgttaaaggttttttttgttttttgttttattgagacagagtcccactctgtcacccaggctggagtgcagtggtgcaatcttggctcactgcaacctccgtcttccgggttcaagccattctcctgtctcagcctcccaagttgctgggactacaggtgcatgctacaatgcccagctaatttttctcatttttagtagaaacggggtttcaccatattggncaggctggtctcgaactcctgacctcaggtgatccacctgccactaccttccaaagtgctgggattacaggcgtcagccaccatgcccagccttaaagttagttttttgtaacaggcatgagccaccgcgcctggctttaaagttcgttttttgtaacaggcataagccactgtgcctggccttaaagttagtttttttgtaacacgaatttaactgttggacagttagtttagatgtgttgcatcatctgttttcaaccagattgtgtttatggacttttcacacactaattttgaggaccccaggttcaaaagtaaaagcagtggccctgctttggggtccaataataggagtgatgggtgaagggacctaagctggccagtagccttctgctccagacatgggacgcggatccttgaggtttctggttaaatctgcacatctgtgtttttatatctgttccctacccctgtaatccctaccgcatgcactagttctgtagttttggtctctcgtttaattgtatgcaagtagtactactgggtaaccagagccaagcgtgaatgtgttcagatttctactgttttgcatgataggaaaattgagaaagaatacatataaaagatatagaggcataacatcaatgcagagttggaagttgacctccacggggtgacatggtgtgtgtgagtgtgggtgtgtgataagcttctcaaacctgcatagatgcagtattcttggctttggtagaaagccttggtttaaggctgggcgcggtggctcacgcctgtaatcccagcactttgggaggctgaggcggncggatcacaaggncaggagatcgagaccatcctgtgaatggngaaaccctgtctctactaaaaatacaaaaaattagccgggcgtagtggcgggcgcctgtagtcccagctactctggaggctgaggcgggagaatggtgtgaacctgggaggcggagcttgcaatgaactgagantgtgccactggactccagcctgggtgacagagcgagactctgtctcaaaaaaaaaaaanaaaaanggaaanccttggtttaggggtttaagtcttatgtggtggttagatcttaaaggacaaagcagtatattggtagttntcaatatagcagtactagctctgtttatataaatagagaaatggagttagccatagaggttaaaactacctggttatcccatatattaacccaaactgggtcttggatacacagttgtatttaatgttttacgatctagcctttccagtataggcacttcctgaaaaacctttgtcctcatttggggcattttgttgttgggtttcgcc

SEQ ID NO: 31863 - DNA, 1221 bp, Homo sapiens
tctcattctgttgcctaggctggagtgcagtggcatgatcttggctaactgcaacctctgcctcccaggttcaagtgattcttctgtcgcagcctcccagtagctgggattacaggcactcgccaccacgccattctcatttttgtactttttttttttttagtagagatggggtttcgccatgttgaccaggctagtctcgaactcctgacctaagtgatctgcctgcctcggcctcccaaaatgctgggaatacaggcatgagccaccgcgcccagccaagttgagtaactttcaaaggtcacacagctaatgtatgcactgtgtactcacaaaaaaacagctttttataagggcctccaattcttgtaataccttgttcaaaaagtattatacctctgagtcaccgctaggaaaaaaaaaagtgaagaaccaggacaatctgaatccatactctgtttgctcacccactgttattctgcctgcgtgccttggcgagaacaggtctctggactctggctgggggcagcctgcggagggctctaggacagatcctgcttgtttcattagtagcctggattgattgattgattgattgattgattgattgattttgagacggagtctcgctctgtcacccaggctggagtgcagtggcaagatctcagctcactgtaagctccgcctcccgagttcacgccattctcctgcctcagcctccagagtaactaggacaggcacccgccaccacgcccggctaattttttttgtatttttagtagagactggtttcaccgtgttagccaggatggtctcgatctcctgacctcgtgatccgcccgcctcggcctcccaaagtgctgagattacaggcgtgagccaccacgcctggccctagcctgggttttatttctaagggaacacatctttaactaagtgcagaggctcacaacttagttatctatttaaaccaagtcacataaacacacaacacacaattccccttacctctttgaagaaaaaaataaccatttgaagtcaggtcagcatgggtttttgtttgtttgtttgttttgttttttgagatgtagtctcgctctgtctcccaggctggagtgcagtggcacgatcttgactcactgcaacctccgcctcccgggttcaagcgattctcatgcctcagcatcgaggcacaagaaactgggattacaggtacgtgcc

SEQ ID NO: 31864 - DNA, 627 bp, Homo sapiens
aggctctaggacagatcctgcgagacggagtctcgctctgtcacccaggctggagtgcagtggcaagatctcagctcactgtaagctccgcctcccgagttcacgccattctcctgcctcagcctccagagtaactaggacaggcacccgccaccacgcccggctaattttttttgtatttttagtagagactggtttcaccgtgttagccaggatggtctcgatctcctgacctcgtgatccgcccgcctcggcctcccaaagtgctgagattacaggcgtgagccaccacgcctggccctagcctgggttttatttctaagggaacacatctttaactaagtgcagaggctcacaacttagttatctatttaaaccaagtcacataaacacacaacacacaattccccttacctctttgaagaaaaaaataaccatttgaagtcaggtcagcatgggtttttgtttgtttgtttgttttgttttttgagatgtagtctcgctctgtctcccaggctggagtgcagtggcacgatcttgactcactgcaacctccgcctcccgggttcaagcgattctcatgcctcagcatcgaggcacaagaaactgggattacaggtacgtgcc

SEQ ID NO: 31865 - DNA, 372 bp, Homo sapiens
gagaataccacaaagaagtggatagatggcagatgacacatgcgagacccaaagtgctaatttcctgaatatacaaagagctcttacaagttaatcaaaagacaaataactcaatgaagtaatgggctcttgcctatgttatgaatattttcatctggtatgacatttactctttgatttcattatttttgtgattttcataggcttgtattttatgtagtcaaatctctatgtctttctatcacttttgtgtttagaaggacgttcctccttctgaagtacacatatttgattttggatttgagatggcattcatttctgatccatctataaagtttttggtgtgtggttaaaggtaaaaatagactcaca

SEQ ID NO: 31866 - DNA, 583 bp, Homo sapiens
ttaccttagttatcacatttcttttattgacataattcataatcatcagaatcatctgacttgtacatcattgtatcagttggttttatgctcaagatgttgtattggttcattattgtcttaatatcccaaccaacccaatctagacataaatgctggcccctgtgacatggcaggaaagggagacaggcctgggccaagcatagtgatagcaatgcacctgtgtttgaagctgttaaatatttgctacagtcgtattcctagactcaaaattagattcttgttaagtcctacttgtcagtgtctatggctgtgtgagttctggttagtagaaggtgggcaaaagtgatgtgtattcttccataactggtccataaccacctaccactcacaatactccatgcctttttttctcttcaggctccttggattagagaccatcctgaggacatccttgggagccatgtgctgaagatggccaagccacaggatgaaaggagctgcatctttgagtcaccactggagaaaggtctctctaaatggatttgcagagacgtcttctcgaatactccccttctaagtt

SEQ ID NO: 31867 - DNA, 240 bp, Homo sapiens
ctaagagcgagagctccgggaaaggagccgatcctggtggaagactacaggtctgagtccactggacgaaaaacgaggctccttggattagagaccatcctgaggacatccttgggagccatgtgctgaagatggccaagccacaggatgaaaggagctgcatctttgagtcaccactggagaaaggtctctctaaatggatttgcagagacgtcttctcgaatactccccttctaagtt

SEQ ID NO: 31868 - DNA, 331 bp, Homo sapiens
cgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgc

SEQ ID NO: 31869 - DNA, 468 bp, Homo sapiens
ggaattgaagcacaacaggtagttttacttcttgaggattaccagtttgtacatcctacatttttggagatgatcaatagccttttgtcttcaggtgaagttcctggactctatactcttgaagaattagagcccttgctgttaccacttaaggatcaagcttcacaagatggtttttttggaccagtcttcaattacttcacatatagaattcagcaaaacttgcatattgtcttgataatggattctgcaaattcaaacttcatgataaactgtgagagtaatccagctttgcataagaaatgccaggtgttgtggatggagggttggtccaatagcagtatgaagaaaatacctgaaatgttattcagtgaaacaggtggtggagaaaaatacaatgataaaaaacgaaaagaagaaaagaaaaaaaattcaggtagtattttgataaaatcagtttgatctggt

SEQ ID NO: 31870 - DNA, 890 bp, Homo sapiens
ggattttacagctggatgaaatcttagaaataattcagtttaacctcctcttttttaaaccacctcactgtaaaaatagaaatccaaaggctctaggtgccaggctggcctgcccctgtcctctgctgttccctctgttgacgaattgatgagctgactcaccctgcccctccctggacctcagccctggggcttggccattgtgagcctcatctgttctgtgaagcgtgttcaactccagctgaataccagaaatgcaatgtccctgtttacttccaattcaggtagaattgtatatacttcccttatacagcttcccacactgagctgtctcaccatctctggacagatgagtaattcgtgcctgctctcccttctcagtttgtcttctgtgtgaactgccaacatggtctctcctttttagaaagtcacatactgtgagtgcaactttgtggaagtcaatgtacataaacatgtgaaatgtgcatcccagctactgtagataatgaggcagctgtatatgtaatgttgaggaacaatcaccaagataatttcagtggaaaagccagcacagaagaggctgaggagcacgctgccatgtatctacgcatagtgtagctctagcaggattcgcgaggagcaagtgacagcaggtgcctctgcagagaggaactggggacaacagtggggatgaagttaatacgtcgtcattattttattttttagatattctacaatgtgaatttactatttattaaaaaataaataaaattataagcgggcatgttggctcatgcctgtaaactcagctgagatgggagaatcacttgaggctgagagttcaagaccagcctggtcaacatagcaagaccctatctctacaaaaaaaa

SEQ ID NO: 31871 - DNA, 1084 bp, Homo sapiens
gaccttaggagaaagacgcttagtaattacagcccttgtcaaggcacagttttttgtttcaaaggttgttaacagttattgtggaaaaatcagtacctctattctgttgtagcagctgggtttaaaatctgcagtgagagttttggggacagttttgttcttaagaacaaagcgccttggcagggaaatgttagatattcaaattagtgatctggccactgaaagatacccagtaaccaggttgggctgcatccagccactggaaccactcaataggtacagagctgggactggaggagaaatcactcacaggggttcctgccagcctgcctgatacctactctctaaggaacaagtaggcaaaggcacttcccatccctggccctcagtttcctcatctgcaaaaggttggttttgggtggttttcaaacaggtaatagcttcaaacttaagctgattccaggtcagcaaataaagccaataacatggagaacagctcttggatgtatagtgggtgctgggagttcctccttcctgccacctcctaacccgctccctccctggccaggaggaggcatttctgacatctcctccttctccctaggagcactgaggctgttccagacccatgcagcctaaggaagactccttctgtgctgtgggtgcacccgtctcccccacttatttttttattattattattatttgagacagaatctcttgaacctgggagatggaggttgcagtgagctgacatcgcagtactgcactccagcctgagcaaaaaaaaaaaaaagaaaaagaaaaaagagcccttttatttaagtatttaaccagaagagaaactaaggatcagagagaaaatgtgggaaaagaaaaattgtaggcagaaggttttacctggctgaaaatcatccacaaatgattttctttctcctcaaaacattgagtctctctctctttttttttttttctgctgtgttgcccaggctgaggcaagagaatctcttgaacccatcttggcagtgagctgagattgcgctactgcacaccagcctgggcaacagagcaagactccatctaa

SEQ ID NO: 31872 - DNA, 738 bp, Homo sapiens
gtacctaggatatcctgtgaaccctgctctctcccacctcacgacactggtcctctttacttgtccttaaaccgcacatgtgtatttttatttctttgaggaagactgggtggcaggcacctgtgtgtgtgtctggaaacatatagcaagctagaggcagatttcaggcaaaaaaaaaaaatgctcttttgggctgggcgtggtgactcacatctataatctcagcagacaggtggatcacctgaggtcaggagtttgagaccagcctggccaacatggtgaaacctcgtctctactaaaaatacaaaagagctgggtgtggtggtgcatgcctgtaatcccagctgctcgggaggctgaggcaggagaatctcttgaacctgggagatggaggttgcagtgagctgacatcgcagtactgcactccagcctgagcaaaaaaaaaaaaaagaaaaagaaaaaagagcccttttatttaagtatttaaccagaagagaaactaaggatcagagagaaaatgtgggaaaagaaaaattgtaggcagaaggttttacctggctgaaaatcatccacaaatgattttctttctcctcaaaacattgagtctctctctctttttttttttttctgctgtgttgcccaggctgaggcaagagaatctcttgaacccatcttggcagtgagctgagattgcgctactgcacaccagcctgggcaacagagcaagactccatctaa

SEQ ID NO: 31873 - DNA, 856 bp, Homo sapiens
ggtctggaaaatagagcccacagtgagcaatttaatgccttttttaggctgcccaaaggagagagtttgaaagaagtacatgaatgtttcttatgggtaccattcagccacttcaatactcatgggaaaatgtgcatctcagaaaattatatctgctttgctagccaagatggcaatcagtgtagtgtaatcattccactacgagaggtcttagctatagataagacaaatgattccagcaaatctgtcatcattagcatcaaaggaaaaacagcttttcgcttccatgaagttaaagactttgaacaactggtagcaaaactcaggctcagatgcggagcagcttcaactcaatatcatgatattagcacagaggtaattaattatacagcaatcaaatcatttggaaaaaaaggtgtgtgtttagtgtagcccattcttcaagaggaattcatagtacctttcctatttatgcccaggggttttttttaaagatagaatctaagaaattatattgtctaactcacatccttaagcagaagtgagaattaaggactttattcatttttaggaacccatacattataaaattactataatttgatctttcttttactctatttgctgtttaccatataaatataccttgtactttcacatagtttggtttttaagaagtcaaaatatatttgagaattcagtgaggcctcgaaaaaggactcctcttactgttgcaaagacatagcaattttaaacctgtctggatatcttttatttaatatcttataggtcagccttatttacataatctggccaaaagcaaaatagtggtatatctgtttactagtaaaatatt

SEQ ID NO: 31874 - DNA, 529 bp, Homo sapiens
ggtctggaaaatagagcccacagtgagcaatttaatgccttttttaggctgcccaaaggagagagtttgaaagaagtacatgaatgtttcttatgggtaccattcagccacttcaatactcatgggaaaatgtgcatctcagaaaattatatctgctttgctagccaagatggcaatcagtgtagtgtaatcattccactacgagaggtcttagctatagataagacaaatgattccagcaaatctgtcatcattagcatcaaaggaaaaacagcttttcgcttccatgaagttaaagactttgaacaactggtagcaaaactcaggctcagatgcggagcagcttcaactcaatatcatgatattagcacagagcttgctattagttctgagtctacagagccatctgataattttgaggtgcaatctttgacaagtcagagggaatgcagtaaaactgtgaacactgaagccttaatgacagtatttcaccctcagaatttggagactcttaattctaaaatggtag

SEQ ID NO: 31875 - DNA, 301 bp, Homo sapiens
tgcatggggatctagctgttccagcaccatttgttgaaaagactatctttgctttactgtgttgcctttactcctttgttaaaaccagtttactttaattttgtgggcctatttctgagttctctattctcttccactaatctatttgtctgttttttcacaaacaccacattgtcttgattaccatatatctatagttaactcttgaagttgggtagtgtcagccctccaactctgttcttctcctttaatattgagttggctacactgaatctgttgcctctccatataaattatagaa

SEQ ID NO: 31876 - DNA, 1097 bp, Homo sapiens
ctactgcggtggaagtcttagagtagccaccttctctgtactcagaccttcacttcgccagatgtcagcacagcagtgtcagcagcttcgtcaaacacaaacaccaccacctctctggatcagaagcacatggaaagcccaccttgcaagaagacccagctattccaaaagtacccatatccctgtagcatcctcttagctgaatgtctctactccttaaacttgtaccactttgaagagtaaaaatttaaattcattcatattatcattttttagtttttagtataagtggagctgtttatcggccatttgtatgtccttttcttttttttgcaaattactcctttgccaaattttctctcaaatgactcatctttttcttattgatttgcagaagctatttacatattatggatgtggggtgtctaacatacacagcaaatactttgtcccagtgtgtcactttttaaaaaaattcttataatgtctttcatctttaaaaaattattaagctattgtgagcttttatgccttttcagtttattttcttacatagataattatatgaagtgcaaataggggcagtgttagtctcatcttcccaaggctgacctcagatgtggaatgttgacagcaacacctgttaccttgtttctgtttaggattttagcgttaaggccaggcataatggttcatgcctgtaattccagcactttgggaggccgaggtgggcagatcacttgaagccaggagttcaagaccagcctggccaacatggagaaaccctctctatttttaaatacatttaaaatgttaacaattaaaacaaaatattttaccgttagtatgatgcttgatacaggatttctggtacatacgccttatcaaattaaataagtttccttttactcttgtttattgttattttttaaaataaggaatgaatcttggattttagtgtatcaataattatattttattctttaacttcataatattccttataattccttatgtcatattaaagatgtaaattcatatatattttatcatacaaatgattaataaatgtataagcatgtcattatatgagagta

SEQ ID NO: 31877 - DNA, 490 bp, Homo sapiens
ttcttggcctccataattatgtaagccaattcccataataaatctcctatctatctatctatctatccatctatcaatcatctatctagtctatctatctatctatctctatcctattgattctgtgtctctgaggaaccctaatacacctccagaactgtgagatgatacatttctgtggtttaagccactcagaaggtggtactttgtttcaccaggcctagcaaactaatacaagtgcatggaaggtgactactcatgactgcaacttagagaacaagggttataataaaaataaaagtgttatacaaaggtggcaagataaatgacaataaatgaaaatattaacatgtgaattaaaaagtaaagatatttttcctagcattctcccagaaagtagagacgcgtctctcttgtttgccatcatatccagcaatggcaagataagttctaggcacttcataaaaatttgttgaatgaaagaaatgaa

SEQ ID NO: 31878 - DNA, 460 bp, Homo sapiens
tcacatccctttaggacttgttaatgtgttcagaatgcttatgatcatgatacagcttcagtaggtggcagttctgcagactcaaagcatttttagtgacaaatcttgtgaagtagttgtatctgttttttttttttttttaaagttcactttccagggcactgaaaaacactagaaggaagtgccctgataaactacagcatttaatactttagactcactgaaagaagtgcttttcttagttcttgacgtttctccaagaactttatacatttaattttacctttcccgatcaaatagaacattgtatcataactatagtgttagaaaatacttttggccaggctgggtggctcaaacctgtagtcccagcactttctgaggtgaggtgggaggatctcttgagcccaggagtttgagccagactgggtaacgtagtaagaccctgtctcttaaaaac

SEQ ID NO: 31879 - DNA, 2018 bp, Homo sapiens
gttcgatgctggtttagggtttcaggcgtggaggttccaaaatccgaggtttgatttcagcctgcccttgccagtgcctgggccgctgggagccgttattggctgccgttaaggaccgttacgtttcccgggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccacacacacacacacacacacacacacacacacacacacacacacggactctccgaatcagggctgggcctctgtgccaggccatcccgtctttggagtgtatcctatttgaggtcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctgggaggccaagggttcactgggcttgaatcctctctaagcacctaccccattatggcctaaacctcctcagtggaccacgggaaatcatgttggaccaagggtttccatgttcaaacagtcaacaaggccctcccctaggttgagatatttttgatactgaaggcccaggccccccagtatggcttgctgccagcaagcagcaaggattctctcgtgggtaacgctgtagccaggcaggaccagcctcttctgggagacccctctccccacgtagggtttgtgtagtgctcccacatcctgcttattgcctgccacccctgcttctcgcctggacctcttggtattccgtgtacaccatccttgctgtttcttgcctctgtgccttcaacctgctgctcctggcctgggataccttttattttcttttatttcttcttcctttttttttttttttttttttttaacctacaactagctctcagttcaggcactgtctaaagccccaggctgggttaggtggtctaggataccaactccccctcaacattttaccttaatccaacagtacagtaattagccgaaacttgcctggtttttcctactagactgtaagccctctagggacagggacagtgtcttattcatctctgtgttcttagtgcagagcctggcccgctgttggtgtttaataaagtgtgttgatctgaaatgccccagacc

SEQ ID NO: 31880 - DNA, 2266 bp, Homo sapiens
ggccgcggctgctacgcggggctgccaccgccccgggcgacccaatttcgcggcctagtggggcgtacgggcctcttttgaaagcctgagttacgatgtattgagcgcgtcgtatgcggccagcactagggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccacacacacacacacacacacacacacacacacacacacacacacggactctccgaatcagggctgggcctctgtgccaggccatcccgtctttggagtgtatcctatttgaggtcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctgggaggccaagggttcactgggcttgaatcctctctaagcacctaccccattatggcctaaacctcctcagtggaccacgggaaatcatgttggaccaagggtttccatgttcaaacagtcaacaaggccctcccctaggttgagatatttttgatactgaaggcccaggccccccagtatggcttgctgccagcaagcagcaaggattctctcgtgggtaacgctgtagccaggcaggaccagcctcttctgggagacccctctccccacgtagggtttgtgtagtgctcccacatcctgcttattgcctgccacccctgcttctcgcctggacctcttggtattccgtgtacaccatccttgctgtttcttgcctctgtgccttcaacctgctgctcctggcctgggataccttttattttcttttatttcttcttcctttttttttttttttttttttttaacctacaactagctctcagttcaggcactgtctaaagccccaggctgggttaggtggtctaggataccaactccccctcaacattttaccttaatccaacagtacagtaattagccgaaacttgcctggtttttcctactagactgtaagccctctagggacagggacagtgtcttattcatctctgtgttcttagtgcagagcctggcccgctgttggtgtttaataaagtgtgttgatctgaaatgccccagaccaaccaagattcccagacttggcttcttcccacactgggctggagtcctcccggagctcagggggaggtgagggccccagaaggtgcacttgccatcaggcttctccctgggtcccaggaggactgcagccaggcccgaggcacctttgtgggaggtgggtagagggctgaggcagcgtcacaccttcttgccccgcctccccatctgccttccccaacccaattagaccagcgcagacataagccttcc

SEQ ID NO: 31881 - DNA, 2173 bp, Homo sapiens
ctagaggcggaggcctgggccacggcggaggcgctgggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccacacacacacacacacacacacacacacacacacacacacacacggactctccgaatcagggctgggcctctgtgccaggccatcccgtctttggagtgtatcctatttgaggtcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctgggaggccaagggttcactgggcttgaatcctctctaagcacctaccccattatggcctaaacctcctcagtggaccacgggaaatcatgttggaccaagggtttccatgttcaaacagtcaacaaggccctcccctaggttgagatatttttgatactgaaggcccaggccccccagtatggcttgctgccagcaagcagcaaggattctctcgtgggtaacgctgtagccaggcaggaccagcctcttctgggagacccctctccccacgtagggtttgtgtagtgctcccacatcctgcttattgcctgccacccctgcttctcgcctggacctcttggtattccgtgtacaccatccttgctgtttcttgcctctgtgccttcaacctgctgctcctggcctgggataccttttattttcttttatttcttcttcctttttttttttttttttttttttaacctacaactagctctcagttcaggcactgtctaaagccccaggctgggttaggtggtctaggataccaactccccctcaacattttaccttaatccaacagtacagtaattagccgaaacttgcctggtttttcctactagactgtaagccctctagggacagggacagtgtcttattcatctctgtgttcttagtgcagagcctggcccgctgttggtgtttaataaagtgtgttgatctgaaatgccccagaccaaccaagattcccagacttggcttcttcccacactgggctggagtcctcccggagctcagggggaggtgagggccccagaaggtgcacttgccatcaggcttctccctgggtcccaggaggactgcagccaggcccgaggcacctttgtgggaggtgggtagagggctgaggcagcgtcacaccttcttgccccgcctccccatctgccttccccaacccaattagaccagcgcagacataagccttcc

SEQ ID NO: 31882 - DNA, 1380 bp, Homo sapiens
ctagaggcggaggcctgggccacggcggaggcgctgggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccacacacacacacacacacacacacacacacacacacacacacacggactctccgaatcagggctgggcctctgtgccaggccatcccgtctttggagtgtatcctatttgaggtcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctgggaggccaagggttcactgggcttgaatcctctctaagcacctaccccattatggcctaaacctcctcagtggaccacgggaaatcatgttggaccaagggtttccatgttcaaacagtcaacaaggcccgctccccacaatgaaataaagttattttctcattcccaaaaaaaga

SEQ ID NO: 31883 - DNA, 343 bp, Homo sapiens
gtgatactctaacataaagccataaatgcactcccaacattgaattctagttatctgcttctgtgtttttccctccctgcactgtgagctacagaacatagagaagaccatatcctactcaacctcatatctcaggtgctaagcactgtgcctgaccgaaggagcactcgatggatgtttatctaataaagtaagaaaggaagaacagcacacatccaaaaatattaagctgtttctatcttccttgacaaaacaaccttatggccaggtgcggtgactcacgcctgtaatcccagcactttggggtttcaccatgttggccaggctggtcttgaactcctgg

SEQ ID NO: 31884 - DNA, 292 bp, Homo sapiens
tgttctttcctttcactccgcgtttgctctcccagtctctcccttcctgggaacggcgcgcgctgacatctccgtgacttcccaacccgtcggtccttttaactttgcccaggccgccttctgttgatctatctcttgtctgtccgctccctacttaccgaaattcttaccttttttggacctcttgacaccaaattagcctagttctcctgcttccctgctgtctgctgctcttctgtttggttttgtccctgaagtgtggttgtttcccccaagtctccgtgagggtctg

SEQ ID NO: 31885 - DNA, 6067 bp, Homo sapiens
  misc_feature (1642)..(1642): n is a, c, g, or t
  misc_feature (2730)..(2730): n is a, c, g, or t
acctccagagaggcccaacagggagctcgcgcggtcgtttggtctcggcggccgtagaagccgggcgcactggaccggagctgccccgccggggttgggtcgtggctgccagggcgcgtcgccaggaggcctcgcgggccgcccttccgctctcccggggctgggcggcgctgtccggctcttcctgccgcgctctggccactccccctcgcccctcgctgggcttggccttggcggccgtgctctgcaggcagtgcctccctcgggcgtgggtctgcaggagagccggacagggcagcggccggcactaccgcgctgcgatttgcgcagagctgaagaagcccctgaccattgaagaggtggcccccgccccgtcgggcctcacgaggtcagagttgatgtccatttctgtggagttaactttggtgatattttgatctgccgtgatcaatatcaggaaaggccccatcttcccttcacacctgcctggcatgggagggcaggattgtggtggtgggatttgctggaggaaacattgcttctgaaccagccaaccttctgctcctgaagaatatctctgctatgggcctgtactgtggtcaatacaaagatatgaactttcccgtcttctccaagagcctatcttcagtgcttcagtactgccagcaagggtgcatccagctatatgtcagaatggttttcaagctggacgaggaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctggtgggttctaaaatgatcagaagagttgattgaatctgatgtggaagggctgggtggcaagtctctgggaaagtcagccttangatggatcattgtccacctcatttgcttatgtaggtcacctgggcagagaggtcaactttggttccattttctctctttttgcttgtaatagtaattgcatcatagctgattcctggaagggaacactgcccctatccattatcaagttgggaaaggaggcactcagtggtgcttttaagaaagggaagaccagagagaattaggaaaagcaaaagcaagatgcaaagcttcattgctttgtctggatgtaggaactttgtcatgagtatagaggccatgaaagccagagactccttggcctctcagcatcactgagagtctgggctgagagcattatcatttggactgaatcatcaagcccacgcattgtattctgacaccttctcagaggcttaaatctgactggagcagggaacatgggcttcttctaattacacaacccacccagaatcttattttggttcaggcagaatttgggcagaaatacatctgtggcatattcctaaactaaagaaaagtgatggaagtaacgctaacaatgtccatctgtgtctgttggtcagaagatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggtaaagaagacccagtgtccctggaatgctggcacactgcttacccaactactcctaacatgcttaccttgctttcctgtgcctgagccggggcatctccaggaatgggatgctcttgcgggaaactgggccatgtaccccctggattaggagggtgcaggaatgggtggggctcttctctgaaagaattgatgctacagttgtgtttttcctgagatgtcaatgtctcatctttagcaacaaaattcacttttttctttctgctttctccacaaggccttgagccatatcctagccccacggccttggggtctgacactagacttgactgaaaggggcctagggtggccacagtcttaaacacaaaatctnattgttttattccaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagagcacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattaacttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcctaaaaattcatccctttcataagaggggaagaatgagtgcctgatattgttaatacctccctttctacctcaggcctttgcaaattgatgttcagagggtcactggagtgagagggaggaggggggcgtcttggaaatttccatttctcttttcaaacccaaaataggaatgactcttgctgtttgtcagatttgctgaaaattgctcctcacaaagaacatttttttttgtacatgtaattgtaaatacaggtttagtacgttaatgttctatagttctgatattgataataattaaacccagataattttatagcaaaagctt

SEQ ID NO: 31886 - DNA, 2932 bp, Homo sapiens
  misc_feature (1930)..(1930): n is a, c, g, or t
  misc_feature (2676)..(2676): n is a, c, g, or t
  misc_feature (2679)..(2679): n is a, c, g, or t
gtgggaatttggatgatttctcatgaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctgaagatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacaggtatgcgacctgggagaaaggaaacagtaaggacattttccaagggactgttttagcccttgtgatccanttttcattttctcatgtgaatttcagctaccgccggctcccttatttgggattgttatctgtgcaggtctgtgcaaggagatgccccgtgggccccacattacagcattggcgggggcctcaggccacaggtcctcctctgcaaagaggtgggctgatgcctttgtgtggtattgtgccctttggccactgggtggcaccctggctccacaagctaactttgttcctttaaaaaaacaacattttacatgtggaggcttgtgggtccgtgttaggcagccctgggcctgttctgagagcctacccaggcaaaactggaaaatggaagaagtttatgtttagtccctctttggggccctagcatccctacaatgacttggtgcacaagctacttagagtcccactggtgacattctctgttggccatagcattaggcttttcctgcaggaggccctcaatcagctctcagtgaatgaatgcatggacagaacgatttgctccctagaggccctccctgttctgtatctctctatccccctccccatacgtgttaagagtcactaagctcttacgttgtgccaggcattttctttgcactatttcctttaattattacacatttaccctatgaagaagtgaagtgaagcaaagattttaatcgtcacttatggaggaggaaaaccaaggcacagggagatgaaataacttgtctcagatggtacagtgagggtgtgggtgagttggantcngaatccaggcagtcagcctgcaaagcccttttaactgttgcaccacactgcctaccactgaggcagtgtacccagctcattgcctgttccttccaggttcctggtctctgatagcacatggctagcttgtcaaagaatcccttctgtgccaaatgtacaataagtgtgtatgggctaatatgtctcccctcctatgtttacgttggtttatgttgaatgaggaaattcttggaaataaagtcctacccccagg

SEQ ID NO: 31887 - DNA, 679 bp, Homo sapiens
acctccagagaggcccaacagggagctcgcgcggtcgtttggtctcggcggccgtagaagccgggcgcactggaccggagctgccccgccggggttgggtcgtggctgccagggcgcgtcgccaggaggcctcgcgggccgcccttccgctctcccggggctgggcggcgctgtccggctcttcctgccgcgctctggccactccccctcgcccctcgctgggcttggccttggcggccgtgctctgcaggcagtgcctccctcgggcgtgggtctgcaggagagccggacagggcagcggccggcactaccgcgctgcgatttgcgcagagctgaagaagcccctgaccattgaagaggtggcccccgccccgtcgggcctcacgaggtcagagttgatgtccatttctgtggagttaactttggtgatattttgatctgccgtgatcaatatcaggaaaggccccatcttcccttcacacctgggagatagagttattggcacaagaaactttaattgtatggctgaagaatgcgtcactgaccagaaggacctgtggcagattccagaaaaggtctccctataagaagctgctgtcctccctataacttatggcactgcgatttttgctcttgagcattgggcccgtacccagcctgggtaaggactgtgtagatg

SEQ ID NO: 31888 - DNA, 4351 bp, Homo sapiens
cgctgaaggaaggtgggaagccatcagagcaggaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctgaagatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagagcacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattaacttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcctaaaaattcatccctttcataagaggggaagaatgagtgcctgatattgttaatacctccctttctacctcaggcctttgcaaattgatgttcagagggtcactggagtgagagggaggaggggggcgtcttggaaatttccatttctcttttcaaacccaaaataggaatgactcttgctgtttgtcagatttgctgaaaattgctcctcacaaagaacatttttttttgtacatgtaattgtaaatacaggtttagtacgttaatgttctatagttctgatattgataataattaaacccagataattttatagcaaaagctt

SEQ ID NO: 31889 - DNA, 4297 bp, Homo sapiens
cgctgaaggaaggtgggaagccatcagagcaggaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctgaagatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagagcacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattaacttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcctactccctttctacctcaggcctttgcaaattgatgttcagagggtcactggagtgagagggaggaggggggcgtcttggaaatttccatttctcttttcaaacccaaaataggaatgactcttgctgtttgtcagatttgctgaaaattgctcctcacaaagaacatttttttttgtacatgtaattgtaaatacaggtttagtacgttaatgttctatagttctgatattgataataattaaacccagataattttatagcaaaagctt

SEQ ID NO: 31890 - DNA, 4347 bp, Homo sapiens
cgctgaaggaaggtgggaagccatcagagcaggaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctgaagatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagagcacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattaacttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcctaaaaattcatccctttcataagaggggaagaatgagtgcctgatattgttaatacctccctttctacctcaggcctttgcaaattgatgttcagagggtcactggagtgagagggaggaggggggcgtcttggaaatttccatttctcttttcaaacccaaaataggaatgactcttgctgatatgccattcttgctgcagcaagaatggcatatcagcgcaagtaggtcatacaagacgctacttcccctatcatagaagagctatcacctttatgatacgccctataatcattttcctatctgcttcactagtcctga

SEQ ID NO: 31891 - DNA, 6403 bp, Homo sapiens
  misc_feature (1978)..(1978): n is a, c, g, or t
  misc_feature (3066)..(3066): n is a, c, g, or t
acctccagagaggcccaacagggagctcgcgcggtcgtttggtctcggcggccgtagaagccgggcgcactggaccggagctgccccgccggggttgggtcgtggctgccagggcgcgtcgccaggaggcctcgcgggccgcccttccgctctcccggggctgggcggcgctgtccggctcttcctgccgcgctctggccactccccctcgcccctcgctgggcttggccttggcggccgtgctctgcaggcagtgcctccctcgggcgtgggtctgcaggagagccggacagggcagcggccggcactaccgcgctgcgatttgcgcagagctgaagaagcccctgaccattgaagaggtggcccccgccccgtcgggcctcacgaggtcagagttgatgtccatttctgtggagttaactttggtgatattttgatctgccgtgatcaatatcaggaaaggccccatcttcccttcacacctggaatggacttttctgggacagtattggagacaggcacagatgtcaggacagttaaagagggagatagagttattggcacaagaaactttaattgtatggctgaagaatgcgtcactgaccagaaggacctgtggcagattccagaaaaggtctccctataagaagctgctgtcctccctataacttatggcactgcgatttttgctcttgagcattgggcccgtacccagcctgggtaatatagctgctgctggaagtgacgagaagtgcaagctggcgatgcagaggggtgcgcagtccagcgtgaactacagtcagggcagcctgaaggatgcacctggcatgggagggcaggattgtggtggtgggatttgctggaggaaacattgcttctgaaccagccaaccttctgctcctgaagaatatctctgctatgggcctgtactgtggtcaatacaaagatatgaactttcccgtcttctccaagagcctatcttcagtgcttcagtactgccagcaagggtgcatccagctatatgtcagaatggttttcaagctggacgaggaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctggtgggttctaaaatgatcagaagagttgattgaatctgatgtggaagggctgggtggcaagtctctgggaaagtcagccttangatggatcattgtccacctcatttgcttatgtaggtcacctgggcagagaggtcaactttggttccattttctctctttttgcttgtaatagtaattgcatcatagctgattcctggaagggaacactgcccctatccattatcaagttgggaaaggaggcactcagtggtgcttttaagaaagggaagaccagagagaattaggaaaagcaaaagcaagatgcaaagcttcattgctttgtctggatgtaggaactttgtcatgagtatagaggccatgaaagccagagactccttggcctctcagcatcactgagagtctgggctgagagcattatcatttggactgaatcatcaagcccacgcattgtattctgacaccttctcagaggcttaaatctgactggagcagggaacatgggcttcttctaattacacaacccacccagaatcttattttggttcaggcagaatttgggcagaaatacatctgtggcatattcctaaactaaagaaaagtgatggaagtaacgctaacaatgtccatctgtgtctgttggtcagaagatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggtaaagaagacccagtgtccctggaatgctggcacactgcttacccaactactcctaacatgcttaccttgctttcctgtgcctgagccggggcatctccaggaatgggatgctcttgcgggaaactgggccatgtaccccctggattaggagggtgcaggaatgggtggggctcttctctgaaagaattgatgctacagttgtgtttttcctgagatgtcaatgtctcatctttagcaacaaaattcacttttttctttctgctttctccacaaggccttgagccatatcctagccccacggccttggggtctgacactagacttgactgaaaggggcctagggtggccacagtcttaaacacaaaatctnattgttttattccaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagagcacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattaacttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcctaaaaattcatccctttcataagaggggaagaatgagtgcctgatattgttaatacctccctttctacctcaggcctttgcaaattgatgttcagagggtcactggagtgagagggaggaggggggcgtcttggaaatttccatttctcttttcaaacccaaaataggaatgactcttgctgtttgtcagatttgctgaaaattgctcctcacaaagaacatttttttttgtacatgtaattgtaaatacaggtttagtacgttaatgttctatagttctgatattgataataattaaacccagataattttatagcaaaagctt

SEQ ID NO: 31892 - DNA, 6215 bp, Homo sapiens
  misc_feature (13)..(13): n is a, c, g, or t
  misc_feature (40)..(40): n is a, c, g, or t
  misc_feature (1790)..(1790): n is a, c, g, or t
  misc_feature (2878)..(2878): n is a, c, g, or t
aaggctagtgtcntgggttaaaccccgcggctcccgtggnaagtccgggatggcggctctgcaggcagtgctcctcgggcgtgggtctgcaggagagccggacagggcagcggccggcactaccgcgctgcgatttgcgcagagctgaagaagcccctgaccattgaagaggtggcccccgccccgtcgggcctcacgaggtcagagttgatgtccatttctgtggagttaactttggtgatattttgatctgccgtgatcaatatcaggaaaggccccatcttcccttcacacctggaatggacttttctgggacagtattggagacaggcacagatgtcaggacagttaaagagggagatagagttattggcacaagaaactttaattgtatggctgaagaatgcgtcactgaccagaaggacctgtggcagattccagaaaaggtctccctataagaagctgctgtcctccctataacttatggcactgcgatttttgctcttgagcattgggcccgtacccagcctgggtaatatagctgctgctggaagtgacgagaagtgcaagctggcgatgcagaggggtgcgcagtccagcgtgaactacagtcagggcagcctgaaggatgcacctggcatgggagggcaggattgtggtggtgggatttgctggaggaaacattgcttctgaaccagccaaccttctgctcctgaagaatatctctgctatgggcctgtactgtggtcaatacaaagatatgaactttcccgtcttctccaagagcctatcttcagtgcttcagtactgccagcaagggtgcatccagctatatgtcagaatggttttcaagctggacgaggaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctggtgggttctaaaatgatcagaagagttgattgaatctgatgtggaagggctgggtggcaagtctctgggaaagtcagccttangatggatcattgtccacctcatttgcttatgtaggtcacctgggcagagaggtcaactttggttccattttctctctttttgcttgtaatagtaattgcatcatagctgattcctggaagggaacactgcccctatccattatcaagttgggaaaggaggcactcagtggtgcttttaagaaagggaagaccagagagaattaggaaaagcaaaagcaagatgcaaagcttcattgctttgtctggatgtaggaactttgtcatgagtatagaggccatgaaagccagagactccttggcctctcagcatcactgagagtctgggctgagagcattatcatttggactgaatcatcaagcccacgcattgtattctgacaccttctcagaggcttaaatctgactggagcagggaacatgggcttcttctaattacacaacccacccagaatcttattttggttcaggcagaatttgggcagaaatacatctgtggcatattcctaaactaaagaaaagtgatggaagtaacgctaacaatgtccatctgtgtctgttggtcagaagatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggtaaagaagacccagtgtccctggaatgctggcacactgcttacccaactactcctaacatgcttaccttgctttcctgtgcctgagccggggcatctccaggaatgggatgctcttgcgggaaactgggccatgtaccccctggattaggagggtgcaggaatgggtggggctcttctctgaaagaattgatgctacagttgtgtttttcctgagatgtcaatgtctcatctttagcaacaaaattcacttttttctttctgctttctccacaaggccttgagccatatcctagccccacggccttggggtctgacactagacttgactgaaaggggcctagggtggccacagtcttaaacacaaaatctnattgttttattccaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagagcacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattaacttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcctaaaaattcatccctttcataagaggggaagaatgagtgcctgatattgttaatacctccctttctacctcaggcctttgcaaattgatgttcagagggtcactggagtgagagggaggaggggggcgtcttggaaatttccatttctcttttcaaacccaaaataggaatgactcttgctgtttgtcagatttgctgaaaattgctcctcacaaagaacatttttttttgtacatgtaattgtaaatacaggtttagtacgttaatgttctatagttctgatattgataataattaaacccagataattttatagcaaaagctt

SEQ ID NO: 31893 - DNA, 5377 bp, Homo sapiens
  misc_feature (952)..(952): n is a, c, g, or t
  misc_feature (2040)..(2040): n is a, c, g, or t
gtgggaatttggatgatttctcatgaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctggtgggttctaaaatgatcagaagagttgattgaatctgatgtggaagggctgggtggcaagtctctgggaaagtcagccttangatggatcattgtccacctcatttgcttatgtaggtcacctgggcagagaggtcaactttggttccattttctctctttttgcttgtaatagtaattgcatcatagctgattcctggaagggaacactgcccctatccattatcaagttgggaaaggaggcactcagtggtgcttttaagaaagggaagaccagagagaattaggaaaagcaaaagcaagatgcaaagcttcattgctttgtctggatgtaggaactttgtcatgagtatagaggccatgaaagccagagactccttggcctctcagcatcactgagagtctgggctgagagcattatcatttggactgaatcatcaagcccacgcattgtattctgacaccttctcagaggcttaaatctgactggagcagggaacatgggcttcttctaattacacaacccacccagaatcttattttggttcaggcagaatttgggcagaaatacatctgtggcatattcctaaactaaagaaaagtgatggaagtaacgctaacaatgtccatctgtgtctgttggtcagaagatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggtaaagaagacccagtgtccctggaatgctggcacactgcttacccaactactcctaacatgcttaccttgctttcctgtgcctgagccggggcatctccaggaatgggatgctcttgcgggaaactgggccatgtaccccctggattaggagggtgcaggaatgggtggggctcttctctgaaagaattgatgctacagttgtgtttttcctgagatgtcaatgtctcatctttagcaacaaaattcacttttttctttctgctttctccacaaggccttgagccatatcctagccccacggccttggggtctgacactagacttgactgaaaggggcctagggtggccacagtcttaaacacaaaatctnattgttttattccaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagagcacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattaacttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcctaaaaattcatccctttcataagaggggaagaatgagtgcctgatattgttaatacctccctttctacctcaggcctttgcaaattgatgttcagagggtcactggagtgagagggaggaggggggcgtcttggaaatttccatttctcttttcaaacccaaaataggaatgactcttgctgtttgtcagatttgctgaaaattgctcctcacaaagaacatttttttttgtacatgtaattgtaaatacaggtttagtacgttaatgttctatagttctgatattgataataattaaacccagataattttatagcaaaagctt

SEQ ID NO: 31894 - DNA, 3181 bp, Homo sapiens
ggctgccagcctgaggactcataggattctccccagatgatcctctttgccttacagtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagagcacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattaacttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcctaaaaattcatccctttcataagaggggaagaatgagtgcctgatattgttaatacctccctttctacctcaggcctttgcaaattgatgttcagagggtcactggagtgagagggaggaggggggcgtcttggaaatttccatttctcttttcaaacccaaaataggaatgactcttgctgtttgtcagatttgctgaaaattgctcctcacaaagaacatttttttttgtacatgtaattgtaaatacaggtttagtacgttaatgttctatagttctgatattgataataattaaacccagataattttatagcaaaagctt

SEQ ID NO: 31895 - DNA, 6017 bp, Homo sapiens
  misc_feature (1592)..(1592): n is a, c, g, or t
  misc_feature (2680)..(2680): n is a, c, g, or t
tccagatcaaaactccacatctttccccaaaacctgatttcccttctgtgtttccaaaggtgttaccactttccttactaatccaggtttaaaatcttggagtcacctttgattctgtttactaattgctcctaattaatatgattatatagtttattgtccaagagcctatcttcagtgcttcagtactgccagcaagggtgcatccagctatatgtcagaaggacctgtggcagattccagaaaaggtctccctataagaagctgctgtcctccctataacttatggcactgcgatttttgctcttgagcattgggcccgtacccagcctgggtaatatagctgctgctggaagtgacgagaagtgcaagctggcgatgcagaggggtgcgcagtccagcgtgaactacagtcagggcagcctgaaggatgcacctggcatgggagggcaggattgtggtggtgggatttgctggaggaaacattgcttctgaaccagccaaccttctgctcctgaagaatatctctgctatgggcctgtactgtggtcaatacaaagatatgaactttcccgtcttctccaagagcctatcttcagtgcttcagtactgccagcaagggtgcatccagctatatgtcagaatggttttcaagctggacgaggaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctggtgggttctaaaatgatcagaagagttgattgaatctgatgtggaagggctgggtggcaagtctctgggaaagtcagccttangatggatcattgtccacctcatttgcttatgtaggtcacctgggcagagaggtcaactttggttccattttctctctttttgcttgtaatagtaattgcatcatagctgattcctggaagggaacactgcccctatccattatcaagttgggaaaggaggcactcagtggtgcttttaagaaagggaagaccagagagaattaggaaaagcaaaagcaagatgcaaagcttcattgctttgtctggatgtaggaactttgtcatgagtatagaggccatgaaagccagagactccttggcctctcagcatcactgagagtctgggctgagagcattatcatttggactgaatcatcaagcccacgcattgtattctgacaccttctcagaggcttaaatctgactggagcagggaacatgggcttcttctaattacacaacccacccagaatcttattttggttcaggcagaatttgggcagaaatacatctgtggcatattcctaaactaaagaaaagtgatggaagtaacgctaacaatgtccatctgtgtctgttggtcagaagatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggtaaagaagacccagtgtccctggaatgctggcacactgcttacccaactactcctaacatgcttaccttgctttcctgtgcctgagccggggcatctccaggaatgggatgctcttgcgggaaactgggccatgtaccccctggattaggagggtgcaggaatgggtggggctcttctctgaaagaattgatgctacagttgtgtttttcctgagatgtcaatgtctcatctttagcaacaaaattcacttttttctttctgctttctccacaaggccttgagccatatcctagccccacggccttggggtctgacactagacttgactgaaaggggcctagggtggccacagtcttaaacacaaaatctnattgttttattccaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagagcacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattaacttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcctaaaaattcatccctttcataagaggggaagaatgagtgcctgatattgttaatacctccctttctacctcaggcctttgcaaattgatgttcagagggtcactggagtgagagggaggaggggggcgtcttggaaatttccatttctcttttcaaacccaaaataggaatgactcttgctgtttgtcagatttgctgaaaattgctcctcacaaagaacatttttttttgtacatgtaattgtaaatacaggtttagtacgttaatgttctatagttctgatattgataataattaaacccagataattttatagcaaaagctt

SEQ ID NO: 31896 - DNA, 4904 bp, Homo sapiens
  misc_feature (1978)..(1978): n is a, c, g, or t
  misc_feature (3066)..(3066): n is a, c, g, or t
acctccagagaggcccaacagggagctcgcgcggtcgtttggtctcggcggccgtagaagccgggcgcactggaccggagctgccccgccggggttgggtcgtggctgccagggcgcgtcgccaggaggcctcgcgggccgcccttccgctctcccggggctgggcggcgctgtccggctcttcctgccgcgctctggccactccccctcgcccctcgctgggcttggccttggcggccgtgctctgcaggcagtgcctccctcgggcgtgggtctgcaggagagccggacagggcagcggccggcactaccgcgctgcgatttgcgcagagctgaagaagcccctgaccattgaagaggtggcccccgccccgtcgggcctcacgaggtcagagttgatgtccatttctgtggagttaactttggtgatattttgatctgccgtgatcaatatcaggaaaggccccatcttcccttcacacctggaatggacttttctgggacagtattggagacaggcacagatgtcaggacagttaaagagggagatagagttattggcacaagaaactttaattgtatggctgaagaatgcgtcactgaccagaaggacctgtggcagattccagaaaaggtctccctataagaagctgctgtcctccctataacttatggcactgcgatttttgctcttgagcattgggcccgtacccagcctgggtaatatagctgctgctggaagtgacgagaagtgcaagctggcgatgcagaggggtgcgcagtccagcgtgaactacagtcagggcagcctgaaggatgcacctggcatgggagggcaggattgtggtggtgggatttgctggaggaaacattgcttctgaaccagccaaccttctgctcctgaagaatatctctgctatgggcctgtactgtggtcaatacaaagatatgaactttcccgtcttctccaagagcctatcttcagtgcttcagtactgccagcaagggtgcatccagctatatgtcagaatggttttcaagctggacgaggaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctggtgggttctaaaatgatcagaagagttgattgaatctgatgtggaagggctgggtggcaagtctctgggaaagtcagccttangatggatcattgtccacctcatttgcttatgtaggtcacctgggcagagaggtcaactttggttccattttctctctttttgcttgtaatagtaattgcatcatagctgattcctggaagggaacactgcccctatccattatcaagttgggaaaggaggcactcagtggtgcttttaagaaagggaagaccagagagaattaggaaaagcaaaagcaagatgcaaagcttcattgctttgtctggatgtaggaactttgtcatgagtatagaggccatgaaagccagagactccttggcctctcagcatcactgagagtctgggctgagagcattatcatttggactgaatcatcaagcccacgcattgtattctgacaccttctcagaggcttaaatctgactggagcagggaacatgggcttcttctaattacacaacccacccagaatcttattttggttcaggcagaatttgggcagaaatacatctgtggcatattcctaaactaaagaaaagtgatggaagtaacgctaacaatgtccatctgtgtctgttggtcagaagatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggtaaagaagacccagtgtccctggaatgctggcacactgcttacccaactactcctaacatgcttaccttgctttcctgtgcctgagccggggcatctccaggaatgggatgctcttgcgggaaactgggccatgtaccccctggattaggagggtgcaggaatgggtggggctcttctctgaaagaattgatgctacagttgtgtttttcctgagatgtcaatgtctcatctttagcaacaaaattcacttttttctttctgctttctccacaaggccttgagccatatcctagccccacggccttggggtctgacactagacttgactgaaaggggcctagggtggccacagtcttaaacacaaaatctnattgttttattccaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattaacttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcctaaaaattcatccctttcataagaggggaagaatgagtgcctgatattgttaatacctccctttctacctcaggcctttgcaaattgatgttcagagggtcactggagtgagagggaggaggggggcgtcttggaaatttccatttctcttttcaaacccaaaataggaatgactcttgctgtttgtcagatttgctgaaaattgctcctcacaaagaacatttttttttgtacatgtaattgtaaatacaggtttagtacgttaatgttctatagttctgatattgataataattaaacccagataattttatagcaaaagctt

SEQ ID NO: 31897 - DNA, 6350 bp, Homo sapiens
  misc_feature (1978)..(1978): n is a, c, g, or t
  misc_feature (3066)..(3066): n is a, c, g, or t
acctccagagaggcccaacagggagctcgcgcggtcgtttggtctcggcggccgtagaagccgggcgcactggaccggagctgccccgccggggttgggtcgtggctgccagggcgcgtcgccaggaggcctcgcgggccgcccttccgctctcccggggctgggcggcgctgtccggctcttcctgccgcgctctggccactccccctcgcccctcgctgggcttggccttggcggccgtgctctgcaggcagtgcctccctcgggcgtgggtctgcaggagagccggacagggcagcggccggcactaccgcgctgcgatttgcgcagagctgaagaagcccctgaccattgaagaggtggcccccgccccgtcgggcctcacgaggtcagagttgatgtccatttctgtggagttaactttggtgatattttgatctgccgtgatcaatatcaggaaaggccccatcttcccttcacacctggaatggacttttctgggacagtattggagacaggcacagatgtcaggacagttaaagagggagatagagttattggcacaagaaactttaattgtatggctgaagaatgcgtcactgaccagaaggacctgtggcagattccagaaaaggtctccctataagaagctgctgtcctccctataacttatggcactgcgatttttgctcttgagcattgggcccgtacccagcctgggtaatatagctgctgctggaagtgacgagaagtgcaagctggcgatgcagaggggtgcgcagtccagcgtgaactacagtcagggcagcctgaaggatgcacctggcatgggagggcaggattgtggtggtgggatttgctggaggaaacattgcttctgaaccagccaaccttctgctcctgaagaatatctctgctatgggcctgtactgtggtcaatacaaagatatgaactttcccgtcttctccaagagcctatcttcagtgcttcagtactgccagcaagggtgcatccagctatatgtcagaatggttttcaagctggacgaggaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctggtgggttctaaaatgatcagaagagttgattgaatctgatgtggaagggctgggtggcaagtctctgggaaagtcagccttangatggatcattgtccacctcatttgcttatgtaggtcacctgggcagagaggtcaactttggttccattttctctctttttgcttgtaatagtaattgcatcatagctgattcctggaagggaacactgcccctatccattatcaagttgggaaaggaggcactcagtggtgcttttaagaaagggaagaccagagagaattaggaaaagcaaaagcaagatgcaaagcttcattgctttgtctggatgtaggaactttgtcatgagtatagaggccatgaaagccagagactccttggcctctcagcatcactgagagtctgggctgagagcattatcatttggactgaatcatcaagcccacgcattgtattctgacaccttctcagaggcttaaatctgactggagcagggaacatgggcttcttctaattacacaacccacccagaatcttattttggttcaggcagaatttgggcagaaatacatctgtggcatattcctaaactaaagaaaagtgatggaagtaacgctaacaatgtccatctgtgtctgttggtcagaagatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggtaaagaagacccagtgtccctggaatgctggcacactgcttacccaactactcctaacatgcttaccttgctttcctgtgcctgagccggggcatctccaggaatgggatgctcttgcgggaaactgggccatgtaccccctggattaggagggtgcaggaatgggtggggctcttctctgaaagaattgatgctacagttgtgtttttcctgagatgtcaatgtctcatctttagcaacaaaattcacttttttctttctgctttctccacaaggccttgagccatatcctagccccacggccttggggtctgacactagacttgactgaaaggggcctagggtggccacagtcttaaacacaaaatctnattgttttattccaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagagcacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattaacttcacaatgatggagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcctaaaaattcatccctttcataagaggggaagaatgagtgcctgatattgttaatacctccctttctacctcaggcctttgcaaattgatgttcagagggtcactggagtgagagggaggaggggggcgtcttggaaatttccatttctcttttcaaacccaaaataggaatgactcttgctgtttgtcagatttgctgaaaattgctcctcacaaagaacatttttttttgtacatgtaattgtaaatacaggtttagtacgttaatgttctatagttctgatattgataataattaaacccagataattttatagcaaaagctt

SEQ ID NO: 31898 - DNA, 3067 bp, Homo sapiens
acctccagagaggcccaacagggagctcgcgcggtcgtttggtctcggcggccgtagaagccgggcgcactggaccggagctgccccgccggggttgggtcgtggctgccagggcgcgtcgccaggaggcctcgcgggccgcccttccgctctcccggggctgggcggcgctgtccggctcttcctgccgcgctctggccactccccctcgcccctcgctgggcttggccttggcggccgtgctctgcaggcagtgcctccctcgggcgtgggtctgcaggagagccggacagggcagcggccggcactaccgcgctgcgatttgcgcagagctgaagaagcccctgaccattgaagaggtggcccccgccccgtcgggcctcacgaggtcagagttgatgtccatttctgtggagttaactttggtgatattttgatctgccgtgatcaatatcaggaaaggccccatcttcccttcacacctggaatggacttttctgggacagtattggagacaggcacagatgtcaggacagttaaagagggagatagagttattggcacaagaaactttaattgtatggctgaagaatgcgtcactgaccagaaggacctgtggcagattccagaaaaggtctccctataagaagctgctgtcctccctataacttatggcactgcgatttttgctcttgagcattgggcccgtacccagcctgggtaatatagctgctgctggaagtgacgagaagtgcaagctggcgatgcagaggggtgcgcagtccagcgtgaactacagtcagggcagcctgaaggatgcacctggcatgggagggcaggattgtggtggtgggatttgctggaggaaacattgcttctgaaccagccaaccttctgctcctgaagaatatctctgctatgggcctgtactgtggtcaatacaaagatatgaactttcccgtcttctccaagagcctatcttcagtgcttcagtactgccagcaagggtgcatccagctatatgtcagaatggttttcaagctggacgaggtcaatgatgccttccttcatgtgatacaggggaaatccgtgggcaaggtgcttctcgctcttaaataaatccttgcctgagcagcaaagttaacatgtccagatcaaaactccacatctttccccaaaacctgatttcccttctgtgtttccaaaggtgttaccactttccttactaatccaggtttaaaatcttggagtcacctttgattctgtttactaattgctcctaattaatatgattatatagtttattgtccaaaccttttcgagagtaaaagggtgccattagtaattacatcaggaaaacatatcccaggcaaaccaggatatatggtcagcctacttgatgcattatgaaatgcggtgattgccgagttctgtcattctcacctctaagatatctctcatgtccatatcctcttttccattctgactaattaagcctcaactgctattaccagtgaccttctaactgcttttcctacctttaagctattctcaccccctccatccttgtgatgcattattgccatcgtgatcttcccgaagcatagctctgactatggcccatctcagaaaacctacagtggctcaccattgcctgatggtggagttcagagcccttgagctagcatttcattatgaccgtgatttttccccgcaccactttccagccttgtggtccacaattccactgggccttaagtatgtactgaactttcctgcctccctcattttgctctgcttgtgcaattttttccaccctccatctctgtcaaacgtaagccttcctgacctctaagacctacctttgtcatgtacctttaccctcaggcaaggagcaatctcttctcttcctcttctaccttgctgtagcttctccccaaggatttatcacattctgccttgaatcatagggaacagcatgtgtagtggaatgaacacaggcctctgaatccaagatacgagtttaaatcccagctttggaggtggttacttaaagtctcagtgccttcattcttcttcctatataaagtagatattacaatatctaacttacagagtcattgggagctatacatgcagcgattgggtaaagcacctggcacatggcaagcgattagcaaatgctggttacttctacttctttctcttcccttttcccagtctatcataatttccttgagagcaggcaccatgtcttatttacccttgtatttcccacagtacttcccatagtgagttacccttagtaaatactcagtaagttgaattgaatttaaattacctgtaagtcttaaaatgtgggattaaattaagaatatattgtcctggaaatacccaaatgtctattgatggatgaatggataaacaaaatgtggtatacacataatggaatattattcagccttaaaaaggaatgaaattctgacatgtgctacaatatgatgaacctggaagacattatatgtgaaataagccagacagaaaaggacaaatactatatgattccacttatatgaagtacctagagtagtgtaattcatagaaacagaaagtacaggttgacatccaaaatctgaaatgagaaatgctccaaaaactgaaactttttcaatgccgacacgatgctcaaagaaaatgctaattggagcatttcagattttggatttttggatttgggatgctcaactggcataatgtgaatattccaaactctgaaaaaatctgaagtctaaaacacttctggtctcaaggattttggataaaggatactcaatgtgcaacatgtagaatggtggttgcaaggtgggaggagagaatggagagttactgtttaatgatacaatgtttccgtttgggaagatggaaagttttggagatgtgtgatggttatggttgcgcaacaatgggaaggtacttagtactgcttaactgtgcacacttaaaaatggtaaaaatgataaattttgtgtatgtcttaaaacaataaaagaagttttttaaaaaaaca

SEQ ID NO: 31899 - DNA, 2832 bp, Homo sapiens
acctccagagaggcccaacagggagctcgcgcggtcgtttggtctcggcggccgtagaagccgggcgcactggaccggagctgccccgccggggttgggtcgtggctgccagggcgcgtcgccaggaggcctcgcgggccgcccttccgctctcccggggctgggcggcgctgtccggctcttcctgccgcgctctggccactccccctcgcccctcgctgggcttggccttggcggccgtgctctgcaggcagtgcctccctcgggcgtgggtctgcaggagagccggacagggcagcggccggcactaccgcgctgcgatttgcgcagagctgaagaagcccctgaccattgaagaggtggcccccgccccgtcgggcctcacgaggtcagagttgatgtccatttctgtggagttaactttggtgatattttgatctgccgtgatcaatatcaggaaaggccccatcttcccttcacacctggtaatatagctgctgctggaagtgacgagaagtgcaagctggcgatgcagaggggtgcgcagtccagcgtgaactacagtcagggcagcctgaaggatgcacctggcatgggagggcaggattgtggtggtgggatttgctggaggaaacattgcttctgaaccagccaaccttctgctcctgaagaatatctctgctatgggcctgtactgtggtcaatacaaagatatgaactttcccgtcttctccaagagcctatcttcagtgcttcagtactgccagcaagggtgcatccagctatatgtcagaatggttttcaagctggacgaggtcaatgatgccttccttcatgtgatacaggggaaatccgtgggcaaggtgcttctcgctcttaaataaatccttgcctgagcagcaaagttaacatgtccagatcaaaactccacatctttccccaaaacctgatttcccttctgtgtttccaaaggtgttaccactttccttactaatccaggtttaaaatcttggagtcacctttgattctgtttactaattgctcctaattaatatgattatatagtttattgtccaaaccttttcgagagtaaaagggtgccattagtaattacatcaggaaaacatatcccaggcaaaccaggatatatggtcagcctacttgatgcattatgaaatgcggtgattgccgagttctgtcattctcacctctaagatatctctcatgtccatatcctcttttccattctgactaattaagcctcaactgctattaccagtgaccttctaactgcttttcctacctttaagctattctcaccccctccatccttgtgatgcattattgccatcgtgatcttcccgaagcatagctctgactatggcccatctcagaaaacctacagtggctcaccattgcctgatggtggagttcagagcccttgagctagcatttcattatgaccgtgatttttccccgcaccactttccagccttgtggtccacaattccactgggccttaagtatgtactgaactttcctgcctccctcattttgctctgcttgtgcaattttttccaccctccatctctgtcaaacgtaagccttcctgacctctaagacctacctttgtcatgtacctttaccctcaggcaaggagcaatctcttctcttcctcttctaccttgctgtagcttctccccaaggatttatcacattctgccttgaatcatagggaacagcatgtgtagtggaatgaacacaggcctctgaatccaagatacgagtttaaatcccagctttggaggtggttacttaaagtctcagtgccttcattcttcttcctatataaagtagatattacaatatctaacttacagagtcattgggagctatacatgcagcgattgggtaaagcacctggcacatggcaagcgattagcaaatgctggttacttctacttctttctcttcccttttcccagtctatcataatttccttgagagcaggcaccatgtcttatttacccttgtatttcccacagtacttcccatagtgagttacccttagtaaatactcagtaagttgaattgaatttaaattacctgtaagtcttaaaatgtgggattaaattaagaatatattgtcctggaaatacccaaatgtctattgatggatgaatggataaacaaaatgtggtatacacataatggaatattattcagccttaaaaaggaatgaaattctgacatgtgctacaatatgatgaacctggaagacattatatgtgaaataagccagacagaaaaggacaaatactatatgattccacttatatgaagtacctagagtagtgtaattcatagaaacagaaagtacaggttgacatccaaaatctgaaatgagaaatgctccaaaaactgaaactttttcaatgccgacacgatgctcaaagaaaatgctaattggagcatttcagattttggatttttggatttgggatgctcaactggcataatgtgaatattccaaactctgaaaaaatctgaagtctaaaacacttctggtctcaaggattttggataaaggatactcaatgtgcaacatgtagaatggtggttgcaaggtgggaggagagaatggagagttactgtttaatgatacaatgtttccgtttgggaagatggaaagttttggagatgtgtgatggttatggttgcgcaacaatgggaaggtacttagtactgcttaactgtgcacacttaaaaatggtaaaaatgataaattttgtgtatgtcttaaaacaataaaagaagttttttaaaaaaaca

SEQ ID NO: 31900 - DNA, 2549 bp, Homo sapiens
agtcactgaatcaaatcctaatatttactgagcagcctttacgacttaggtacatacactcaatctgtaagtcactgttatctcttttttaggacctgtggcagattccagaaaaggtctccctataagaagctgctgtcctccctataacttatggcactgcgatttttgctcttgagcattgggcccgtacccagcctgggtaatatagctgctgctggaagtgacgagaagtgcaagctggcgatgcagaggggtgcgcagtccagcgtgaactacagtcagggcagcctgaaggatgcacctggcatgggagggcaggattgtggtggtgggatttgctggaggaaacattgcttctgaaccagccaaccttctgctcctgaagaatatctctgctatgggcctgtactgtggtcaatacaaagatatgaactttcccgtcttctccaagagcctatcttcagtgcttcagtactgccagcaagggtgcatccagctatatgtcagaatggttttcaagctggacgaggtcaatgatgccttccttcatgtgatacaggggaaatccgtgggcaaggtgcttctcgctcttaaataaatccttgcctgagcagcaaagttaacatgtccagatcaaaactccacatctttccccaaaacctgatttcccttctgtgtttccaaaggtgttaccactttccttactaatccaggtttaaaatcttggagtcacctttgattctgtttactaattgctcctaattaatatgattatatagtttattgtccaaaccttttcgagagtaaaagggtgccattagtaattacatcaggaaaacatatcccaggcaaaccaggatatatggtcagcctacttgatgcattatgaaatgcggtgattgccgagttctgtcattctcacctctaagatatctctcatgtccatatcctcttttccattctgactaattaagcctcaactgctattaccagtgaccttctaactgcttttcctacctttaagctattctcaccccctccatccttgtgatgcattattgccatcgtgatcttcccgaagcatagctctgactatggcccatctcagaaaacctacagtggctcaccattgcctgatggtggagttcagagcccttgagctagcatttcattatgaccgtgatttttccccgcaccactttccagccttgtggtccacaattccactgggccttaagtatgtactgaactttcctgcctccctcattttgctctgcttgtgcaattttttccaccctccatctctgtcaaacgtaagccttcctgacctctaagacctacctttgtcatgtacctttaccctcaggcaaggagcaatctcttctcttcctcttctaccttgctgtagcttctccccaaggatttatcacattctgccttgaatcatagggaacagcatgtgtagtggaatgaacacaggcctctgaatccaagatacgagtttaaatcccagctttggaggtggttacttaaagtctcagtgccttcattcttcttcctatataaagtagatattacaatatctaacttacagagtcattgggagctatacatgcagcgattgggtaaagcacctggcacatggcaagcgattagcaaatgctggttacttctacttctttctcttcccttttcccagtctatcataatttccttgagagcaggcaccatgtcttatttacccttgtatttcccacagtacttcccatagtgagttacccttagtaaatactcagtaagttgaattgaatttaaattacctgtaagtcttaaaatgtgggattaaattaagaatatattgtcctggaaatacccaaatgtctattgatggatgaatggataaacaaaatgtggtatacacataatggaatattattcagccttaaaaaggaatgaaattctgacatgtgctacaatatgatgaacctggaagacattatatgtgaaataagccagacagaaaaggacaaatactatatgattccacttatatgaagtacctagagtagtgtaattcatagaaacagaaagtacaggttgacatccaaaatctgaaatgagaaatgctccaaaaactgaaactttttcaatgccgacacgatgctcaaagaaaatgctaattggagcatttcagattttggatttttggatttgggatgctcaactggcataatgtgaatattccaaactctgaaaaaatctgaagtctaaaacacttctggtctcaaggattttggataaaggatactcaatgtgcaacatgtagaatggtggttgcaaggtgggaggagagaatggagagttactgtttaatgatacaatgtttccgtttgggaagatggaaagttttggagatgtgtgatggttatggttgcgcaacaatgggaaggtacttagtactgcttaactgtgcacacttaaaaatggtaaaaatgataaattttgtgtatgtcttaaaacaataaaagaagttttttaaaaaaaca

SEQ ID NO: 31901 - DNA, 2488 bp, Homo sapiens
agtgatggtaaggtgatctaggatgaaaacaggacatgagggagaggagaaggcggtgaaggaagatatgccaatgtcttcaaacgacaaggcggagtgactgggaagtgaaaatggatgaggaagaatggagaagcagacagcttatgatagaagccccaggggtgtggggctggatgcaggtggggatattctgggagcactgggcttggcataaatgaaaaccagacagtctctcccagagggatccacctctttgtcttgactggattgtcctcaagacaaagagaaagcacccctataatcagcatcaaaaggggtcatgattcttcttggaggaggcaggatggtgtcattcactacaaagatatgaactttcccgtcttctccaagagcctatcttcagtgcttcagtactgccagcaagggtgcatccagctatatgtcagaatggttttcaagctggacgaggtcaatgatgccttccttcatgtgatacaggggaaatccgtgggcaaggtgcttctcgctcttaaataaatccttgcctgagcagcaaagttaacatgtccagatcaaaactccacatctttccccaaaacctgatttcccttctgtgtttccaaaggtgttaccactttccttactaatccaggtttaaaatcttggagtcacctttgattctgtttactaattgctcctaattaatatgattatatagtttattgtccaaaccttttcgagagtaaaagggtgccattagtaattacatcaggaaaacatatcccaggcaaaccaggatatatggtcagcctacttgatgcattatgaaatgcggtgattgccgagttctgtcattctcacctctaagatatctctcatgtccatatcctcttttccattctgactaattaagcctcaactgctattaccagtgaccttctaactgcttttcctacctttaagctattctcaccccctccatccttgtgatgcattattgccatcgtgatcttcccgaagcatagctctgactatggcccatctcagaaaacctacagtggctcaccattgcctgatggtggagttcagagcccttgagctagcatttcattatgaccgtgatttttccccgcaccactttccagccttgtggtccacaattccactgggccttaagtatgtactgaactttcctgcctccctcattttgctctgcttgtgcaattttttccaccctccatctctgtcaaacgtaagccttcctgacctctaagacctacctttgtcatgtacctttaccctcaggcaaggagcaatctcttctcttcctcttctaccttgctgtagcttctccccaaggatttatcacattctgccttgaatcatagggaacagcatgtgtagtggaatgaacacaggcctctgaatccaagatacgagtttaaatcccagctttggaggtggttacttaaagtctcagtgccttcattcttcttcctatataaagtagatattacaatatctaacttacagagtcattgggagctatacatgcagcgattgggtaaagcacctggcacatggcaagcgattagcaaatgctggttacttctacttctttctcttcccttttcccagtctatcataatttccttgagagcaggcaccatgtcttatttacccttgtatttcccacagtacttcccatagtgagttacccttagtaaatactcagtaagttgaattgaatttaaattacctgtaagtcttaaaatgtgggattaaattaagaatatattgtcctggaaatacccaaatgtctattgatggatgaatggataaacaaaatgtggtatacacataatggaatattattcagccttaaaaaggaatgaaattctgacatgtgctacaatatgatgaacctggaagacattatatgtgaaataagccagacagaaaaggacaaatactatatgattccacttatatgaagtacctagagtagtgtaattcatagaaacagaaagtacaggttgacatccaaaatctgaaatgagaaatgctccaaaaactgaaactttttcaatgccgacacgatgctcaaagaaaatgctaattggagcatttcagattttggatttttggatttgggatgctcaactggcataatgtgaatattccaaactctgaaaaaatctgaagtctaaaacacttctggtctcaaggattttggataaaggatactcaatgtgcaacatgtagaatggtggttgcaaggtgggaggagagaatggagagttactgtttaatgatacaatgtttccgtttgggaagatggaaagttttggagatgtgtgatggttatggttgcgcaacaatgggaaggtacttagtactgcttaactgtgcacacttaaaaatggtaaaaatgataaattttgtgtatgtcttaaaacaataaaagaagttttttaaaaaaaca

SEQ ID NO: 31902 - DNA, 3013 bp, Homo sapiens
acctccagagaggcccaacagggagctcgcgcggtcgtttggtctcggcggccgtagaagccgggcgcactggaccggagctgccccgccggggttgggtcgtggctgccagggcgcgtcgccaggaggcctcgcgggccgcccttccgctctcccggggctgggcggcgctgtccggctcttcctgccgcgctctggccactccccctcgcccctcgctgggcttggccttggcggccgtgctctgcaggcagtgcctccctcgggcgtgggtctgcaggagagccggacagggcagcggccggcactaccgcgctgcgatttgcgcagagctgaagaagcccctgaccattgaagaggtggcccccgccccgtcgggcctcacgaggtcagagttgatgtccatttctgtggagttaactttggtgatattttgatctgccgtgatcaatatcaggaaaggccccatcttcccttcacacctggaatggacttttctgggacagtattggagacaggcacagatgtcaggacagttaaagagggagatagagttattggcacaagaaactttaattgtatggctgaagaatgcgtcactgaccagaaggacctgtggcagattccagaaaaggtctccctataagaagctgctgtcctccctataacttatggcactgcgatttttgctcttgagcattgggcccgtacccagcctgggtaatatagctgctgctggaagtgacgagaagtgcaagctggcgatgcagaggggtgcgcagtccagcgtgaactacagtcagggcagcctgaaggatgcacctggcatgggagggcaggattgtggtggtgggatttgctggaggaaacattgcttctgaaccagccaaccttctgctcctgaagaatatctctgctatgggcctgtactgtggtcaatacaaagatatgaactttcccgtcttctccaagagcctatcttcagtgcttcagtactgccagcaagggtgcatccagctatatgtcagaatggttttcaagctggacgaggtcaatgatgccttccttcatgtgatacaggggaaatccgtgggcaaggtgcttctcgctcttaaataaatccttgcctgagcagcaaagttaacatgtccagatcaaaactccacatctttccccaaaacctgatttcccttctgtgtttccaaaggtgttaccactttccttactaatccaggtttaaaatcttggagtcacctttgattctgtttactaattgctcctaattaatatgattatatagtttattgtccaaaccttttcgagagtaaaagggtgccattagtaattacatcaggaaaacatatcccaggcaaaccaggatatatggtcagcctacttgatgcattatgaaatgcggtgattgccgagttctgtcattctcacctctaagatatctctcatgtccatatcctcttttccattctgactaattaagcctcaactgctattaccagtgaccttctaactgcttttcctacctttaagctattctcaccccctccatccttgtgatgcattattgccatcgtgatcttcccgaagcatagctctgactatggcccatctcagaaaacctacagtggctcaccattgcctgatggtggagttcagagcccttgagctagcatttcattatgaccgtgatttttccccgcaccactttccagccttgtggtccacaattccactgggccttaagtatgtactgaactttcctgcctccctcattttgctctgcttgtgcaattttttccaccctccatctctgtcaaacgtaagccttcctgacctctaagacctacctttgtcatgtacctttaccctcaggcaaggagcaatctcttctcttcctcttctaccttgctgtagcttctccccaaggatttatcacattctgccttgaatcatagggaacagcatgtgtagtggaatgaacacaggcctctgaatccaagatacgagtttaaatcccagctttggaggtggttacttaaagtctcagtgccttcattcttcttcctatataaagtagatattacaatatctaacttacagagtcattgggagctatacatgcagcgattggtttctcttcccttttcccagtctatcataatttccttgagagcaggcaccatgtcttatttacccttgtatttcccacagtacttcccatagtgagttacccttagtaaatactcagtaagttgaattgaatttaaattacctgtaagtcttaaaatgtgggattaaattaagaatatattgtcctggaaatacccaaatgtctattgatggatgaatggataaacaaaatgtggtatacacataatggaatattattcagccttaaaaaggaatgaaattctgacatgtgctacaatatgatgaacctggaagacattatatgtgaaataagccagacagaaaaggacaaatactatatgattccacttatatgaagtacctagagtagtgtaattcatagaaacagaaagtacaggttgacatccaaaatctgaaatgagaaatgctccaaaaactgaaactttttcaatgccgacacgatgctcaaagaaaatgctaattggagcatttcagattttggatttttggatttgggatgctcaactggcataatgtgaatattccaaactctgaaaaaatctgaagtctaaaacacttctggtctcaaggattttggataaaggatactcaatgtgcaacatgtagaatggtggttgcaaggtgggaggagagaatggagagttactgtttaatgatacaatgtttccgtttgggaagatggaaagttttggagatgtgtgatggttatggttgcgcaacaatgggaaggtacttagtactgcttaactgtgcacacttaaaaatggtaaaaatgataaattttgtgtatgtcttaaaacaataaaagaagttttttaaaaaaaca

SEQ ID NO: 31903 - DNA, 266 bp, Homo sapiens
gggttaggtggggtgcccctttcttgggacatgttctggataatcagatatcttgtgttcttgatgcaggtaatatagctgctgctggaagtgacgagaagtgcaagctggcgatgcagaggggtgcgcagtccagcgtgaactacagtcagggcagcctgaaggatgcagtaaggaagctggtgggcgagggcggggtgaatgtggccatcgacatggtgggaggagacatctgcctggaggctctccgcaggtgcatggggtgg

SEQ ID NO: 31904 - DNA, 436 bp, Homo sapiens
tcggtacccggtttaccccattctcctgcctcagcccccggagtagccgggaccacaggtgctggccaccacgcctagctaatttttgcatttttagtggagatggggtttcaccatgttgcccaggctggtctcgaactcctgatcgcaaatgatccacccgtctcagcctcccaaagtgctcggcttacaggcatgagtcactgcacccagcctgattcagccttaaaagggaaggatgtaacatgtcatgtgggtgaaccttgaggacattatggtacatgaaatcagccagtcacaaaaggggagatactgtgtgattccacttacatgaggcccctagcgtcaccagattcacacagagagaaagtagaatggtgggtgccaaaggagagggaacagggaattattgattattaggcatggattttcaggt

SEQ ID NO: 31905 - DNA, 432 bp, Homo sapiens
gcacgcaggcacacaagcggctggatgacaagaggggcacatgggcggaggaacacacaagcggctggatggcaggaatacaccaacaggcaccagcaggccatcgactggcgaaacaatgaggagtttggccagggcagtcagaaaagagacaggccgccgagtggcccaaatccagcggaaaaccatctcccttctggttcccccatctgctgagagctacttccaatcaataaaaccctggactaattctccaagcctacgtgtgatcaaattcttccggtatatcaaggcaagaaccctgggatacagaaagccctctgtccttgcaacaaggcaagggggtctaattgagctgactaacacaagctgcctatggacagctaaactgaaagagcactctgtaacacacacccactggggcttcagccg

SEQ ID NO: 31906 - DNA, 920 bp, Homo sapiens
gtttcctactcacattgtggctgtatgagaacacgatgggactgctttgctgttctctttactctgtccttggagaggtgtgaaaagctgtattgctacaggcaatttatttaataattggaagccatattgataatggatgtggtaatatttgtaaagtttaatctactttaagcggcagtaactaatggaatttttttccttgatcacatatgtagcacttttgttactttttaaagatatttatatttgataaatctttttttcattttgagaactcaaaataccaaacagtgaacttgcattctaaagtcaccctgtgatcaccttgtcatctagtagcaaaatgatgaactattcatgcatcaaagaaaattacatctgctggccttgtatgaaaatgatctcttggcatcccgattaaatgacacactgtcactgtgggtaagaggaaagagccttcaatgtagcacgacaggtgcgcctgaaagaggcacaactgctgtggattttctgcctcgctccatctctcctatgtataatgagcccttgtttaaaggggcatgtgggctgggatgttaagcacggcttctttttgtccattacctgaaaacaatttctaagataaaaggaaggtgccatttccttacctcttcacccatcctcctccaccaaatgtattcaacttaaaactgtgagagagagagactgaatgaccttcctcagttttccctttctcattcaggagatactgaatatccgccagtttgtagttggtttccttccacttaaggcacacgctgactgcatcatttccttatctgttaatcctgcttatgtgagtgtgaggaaagtctttgagagggcatgaaagtgccaccttatatatgtctgtgactttaaagagctatatgcagggc

SEQ ID NO: 31907 - DNA, 614 bp, Homo sapiens
gtttaaggggtccaatataaaattagaggtggcacaatctcagctcctgcagcctcgaccccctaggctcaagtgatactcctgcctcggcctccacagtagtaaacttgagtggtttttaaacagatcatacaagcacctggtaaaaaaataaaatgtaagcatgaaagggtaaatagtggaaagacagacgcggctcactcttgatccctgagaactctcatccccaccaaaggtcctcactgcacacagtcttcccatctcactgcacacagtcttcccatctcctccaggggtatttttcacacgcacaattcacacacagaggtctgtgcctatatacccttcctcatgacacagacgaggcagagcccacactttgcctgggaattttctttgcttttttccatgtaataatactgtttggacattgttctgtatctatgcatacacagagtgtctaaagtctggaggctgggcatggtggttcatgcctgtaatcccaacactttgagaggccatggtgggaggatcacttgagcccaggagtttgagaccagcctgggcaacatagcccacacctcatagcaagatctcatctctacaaaaaatac

SEQ ID NO: 31908 - DNA, 380 bp, Homo sapiens
agtactcagtatttacatgatctgtttctgaaaacagatcatgtaagcagaaaactgctattacgagctataataactagtattttcttaaaaagtataccctacgaatccaatgcatatgacaacagtgtttttgacagcacatttttattcaataaatatggtttgtcatattaaattgcatctgtgttttagtggggaaaaaatgatccatgcccttaaataataaaagcacatttaagaatatattataccagtttatccgtttcactgttcattatagcagcaaaaattagaaaatgaccttaatgtccatcaatttgagactgcttaaatggattatggtacatccatgttaaggaatatcacacaaccccagg

SEQ ID NO: 31909 - DNA, 415 bp, Homo sapiens
aatatgatttgcagatattttctgtcattctatatactgtcttttcacattcttgatgatatacttttcagcccaaatgtttttaacttgatggaatacaatttattttttcttttgttgcttgtgctttcagtcatatttgtgaaaactttgcttatcccacattacaaagatttactatttctaagtgatttataattttaccacctacctttaggtctccgatccattttgagttaatttttatgtgcgaggagggagtctaacttgattcttttacatgtggatatttagttgtcccaggaccatttgttgaattaatgcccagaacaagtacatctatatatagagaaagtagattagtggttgtcagagactgcaagaaggggggaattgcagagtgacagcccatagg

SEQ ID NO: 31910 - DNA, 400 bp, Homo sapiens
gagtcgacaacaagggtaggggcactggcacccagaggcaaggaggagtacaggtgggatgaatccagagtgggaggtggagactaccaccaggctatgcaggaccttataaccactttaaaaatttgagaagtctgggtgcagtggctcatgcctgtaatcccagcactttgggaggccaaggcgggcagatcacgaagtcaggagattgagaccatcctggctaacatggtgaaaccctgtgtctactaaaaacacacaaaaattagctgggcgtggtggcgtgccctgtagtcccagctactggggaggctaaggcaggagaatcgcttgaacccgggaggtggagtacagtggtgcaatctctgctcactgcaacctccgtcgacgcggccgcaat

SEQ ID NO: 31911 - DNA, 530 bp, Homo sapiens
ggaaactattcgcccccacagctggcccactgctgagttccccgggaggcttggagcagagggcagtgggcagcagcatcccactgagaactgcagaactctcagcacatgacaactctgtccaaacctctgaactaagagacttgaccaactctagattggcttttagcagcacaaggctgtatccctaggatggccccagcccctcttaaagtgctgtcttgagaaagctcagtgctgccagaaaaatttattatttgttccagccaacacctgatgataggcccctgacctcactttcttagaacatttggctcaaaatggcttgccattgtacatatgtatctcttgcaactcaaaagcatcaggtcttcctttaaaatctagtcatcaaggccaggcatggtggctcacgctgtaatcccagcactttgggaggctgaggcgggcagatcacttgaggccaggagttcaagaccagcttgggcaacatgccaaaactctgtctctactaaaaatacaaaaaaaaa

SEQ ID NO: 31912 - DNA, 911 bp, Homo sapiens
tttctagtaccattccgttccggggcgcgtgcccagtagtgtatggttaaacactggtctatcacccatgtttcactaccgagcatcctgtctcatgacatagttgctttgcctttctcacctaataaaagaagtccggcggaacaggcgatgcgttgtgacaccatgatccagtatggacgttgtctgacgtttcacttagctgggtactctatcgactcagtgcagtctcgacatcggacccttcgcagtatctataacttgacgttacccgatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgta

SEQ ID NO: 31913 - DNA, 2524 bp, Homo sapiens
atctaaattctaatatgacttgtaccttttttcagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatcatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagtaatccaggtctcaggtagtatctttatagcagtgtgagaacagactaattaaacatctatatgttatttggacttaatatggggccgtgtgattgaatctcagtttgcctgtgataaagtagtgtaacagtattgctagctttgcatgaatttgatgctgatgacatgtcagtgtgaaaccatgacgtgtggtctttgattttcattctgcatgtgtgtgtctgtgttttggaacagttatattttggttttgtaaaaacaaccttcactttatttttaactgtgtagtaagtttatattcaatgccttaaagtgcattgttaacaattgtcttgatatgttgtcctcattttagggaaagtcatagaagccaaaatgatcagcagttgagtaatttacgaaagcacaggtgcaatcccactttaaagcactgggggttgcacagagcacactggtttcaggctccataaatgtggatgactcactggagagcttcatctgtttaagtagaacaaatgtttttactctactgataaagtacaggaaaggaggtttgggatcaaaattatttttcacattccaaacctgtgacaccttacgtttatcgattgctatgcaataaaatacatctttaataat

SEQ ID NO: 31914 - DNA, 2866 bp, Homo sapiens
tttctagtaccattccgttccggggcgcgtgcccagtagtgtatggttaaacactggtctatcacccatgtttcactaccgagcatcctgtctcatgacatagttgctttgcctttctcacctaataaaagaagtccggcggaacaggcgatgcgttgtgacaccatgatccagtatggacgttgtctgacgtttcacttagctgggtactctatcgactcagtgcagtctcgacatcggacccttcgcagtatctataacttgacgttacccgatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggtacgtagatgacactttcagttgtctttcttcatgtgtatgtttttcaaatctaaacatgtctcaaacaattgtgtttaggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatcatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagtaatccaggtctcaggtagtatctttatagcagtgtgagaacagactaattaaacatctatatgttatttggacttaatatggggccgtgtgattgaatctcagtttgcctgtgataaagtagtgtaacagtattgctagctttgcatgaatttgatgctgatgacatgtcagtgtgaaaccatgacgtgtggtctttgattttcattctgcatgtgtgtgtctgtgttttggaacagttatattttggttttgtaaaaacaaccttcactttatttttaactgtgtagtaagtttatattcaatgccttaaagtgcattgttaacaattgtcttgatatgttgtcctcattttagggaaagtcatagaagccaaaatgatcagcagttgagtaatttacgaaagcacaggtgcaatcccactttaaagcactgggggttgcacagagcacactggtttcaggctccataaatgtggatgactcactggagagcttcatctgtttaagtagaacaaatgtttttactctactgataaagtacaggaaaggaggtttgggatcaaaattatttttcacattccaaacctgtgacaccttacgtttatcgattgctatgcaataaaatacatctttaataat

SEQ ID NO: 31915 - DNA, 1262 bp, Homo sapiens
tttctagtaccattccgttccggggcgcgtgcccagtagtgtatggttaaacactggtctatcacccatgtttcactaccgagcatcctgtctcatgacatagttgctttgcctttctcacctaataaaagaagtccggcggaacaggcgatgcgttgtgacaccatgatccagtatggacgttgtctgacgtttcacttagctgggtactctatcgactcagtgcagtctcgacatcggacccttcgcagtatctataacttgacgttacccgatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgtaaaaaaaaaaaaaaaaaaccggcacagctcccccttttttagatgatcacatagttctgagcagagatgtggtcctcaaccctgcagttcctgcaggagctgctgctgctgggatggctgctggacagaggcctccatggagcccgctgtgctggtgtcatcagaaagagacgtaaaggaaacccgggatgagagctgctcaacggtcagagttgccaaagctgagctctggccagagttaggagagttcttgagcataaggtcagaagcaggtaagagggggcctagaagttttacaggacagaaagctgatccggttgggatgaaattaaccttgtttttgtcaggacat

SEQ ID NO: 31916 - DNA, 922 bp, Homo sapiens
tttctagtaccattccgttccggggcgcgtgcccagtagtgtatggttaaacactggtctatcacccatgtttcactaccgagcatcctgtctcatgacatagttgctttgcctttctcacctaataaaagaagtccggcggaacaggcgatgcgttgtgacaccatgatccagtatggacgttgtctgacgtttcacttagctgggtactctatcgactcagtgcagtctcgacatcggacccttcgcagtatctataacttgacgttacccgatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaattaacgcatatgactccaatatacgcccttcggggcccggtgtgtgtgcgg

SEQ ID NO: 31917 - DNA, 2785 bp, Homo sapiens
tttctagtaccattccgttccggggcgcgtgcccagtagtgtatggttaaacactggtctatcacccatgtttcactaccgagcatcctgtctcatgacatagttgctttgcctttctcacctaataaaagaagtccggcggaacaggcgatgcgttgtgacaccatgatccagtatggacgttgtctgacgtttcacttagctgggtactctatcgactcagtgcagtctcgacatcggacccttcgcagtatctataacttgacgttacccgatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatcatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagtaatccaggtctcaggtagtatctttatagcagtgtgagaacagactaattaaacatctatatgttatttggacttaatatggggccgtgtgattgaatctcagtttgcctgtgataaagtagtgtaacagtattgctagctttgcatgaatttgatgctgatgacatgtcagtgtgaaaccatgacgtgtggtctttgattttcattctgcatgtgtgtgtctgtgttttggaacagttatattttggttttgtaaaaacaaccttcactttatttttaactgtgtagtaagtttatattcaatgccttaaagtgcattgttaacaattgtcttgatatgttgtcctcattttagggaaagtcatagaagccaaaatgatcagcagttgagtaatttacgaaagcacaggtgcaatcccactttaaagcactgggggttgcacagagcacactggtttcaggctccataaatgtggatgactcactggagagcttcatctgtttaagtagaacaaatgtttttactctactgataaagtacaggaaaggaggtttgggatcaaaattatttttcacattccaaacctgtgacaccttacgtttatcgattgctatgcaataaaatacatctttaataat

SEQ ID NO: 31918 - DNA, 992 bp, Homo sapiens
tttctagtaccattccgttccggggcgcgtgcccagtagtgtatggttaaacactggtctatcacccatgtttcactaccgagcatcctgtctcatgacatagttgctttgcctttctcacctaataaaagaagtccggcggaacaggcgatgcgttgtgacaccatgatccagtatggacgttgtctgacgtttcacttagctgggtactctatcgactcagtgcagtctcgacatcggacccttcgcagtatctataacttgacgttacccgatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggtacgtagatgacactttcagttgtctttcttcatgtgtatgtttttcaaatctaaacatgtctcaaacaattgtgtttaggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgta

SEQ ID NO: 31919 - DNA, 634 bp, Homo sapiens
ttaaatttggtaatcaacataaagcactgatcacattgcccagtgcatagtaagcgctctaaatatctgctatttttatcatgtagtgttggttgaaattggttttgtgttctccactcttagtttaaaaaatagtatgagtcgaatgtttcatattgccctgtctcaggggaaaaaaaaaattgctttttgcatagctctcagttgattcccactcactatgatggctatatagaacacaagttctctaccatttctgcagtattttaaaaattcctttaaaaaactaaatatttattgtgggacaaaatattatatgcttacttagaatattgggaagatggtaaagaatacaaagaaaaaaacaattgtacccctcattctagacacaacttgctgttcacgtctttggggtgtatttccattcctactagatggaaccatttatatgtttacctaattcggatcatgttgcatacagttttgttcccttcaaaattatactttgaggctaggcgcgcatagtggctcacacctgtaatcttagcactttgggaggccaagatgggggaggatcacttgagaccaggagtttgagaccagcctggtcaacatagtgagacctgtctctacc

SEQ ID NO: 31920 - DNA, 3262 bp, Homo sapiens
cccggaagctgccgaccacgtgattcgctggctcagctcacgtgacaaagctcccggaggtgggagccctgggccaaaatggcggcctacctgcagtggcggcgcttcgttttcttcgacaaggagctggtgaaggagccgctgagcaatgatggggccgctcccggggccacacctgcttctggatccgctgcttccaagttcctttgcctccctcctggcatcactgtctgcgactcaggccgagggagcctggtctttggagatatggaaggccagatctggttcttgccacgttccctacagcttacaggcttccaagcctacaaactacgggtgacacacctgtaccaactgaagcagcacaatattctggcatctgttggagaagatgaagagggcatcaaccccttggttaagatctggaacctggagaagagagatggtggcaatccactctgcactcgaatcttccctgctattccaggaacagagccaactgttgtatcttgtttgactgtccatgaaaatctcaactttatggccattggtttcacagatggcagtgttacattgaacaaaggagacatcacccgggaccggcatagcaagacccagattttgcacaagggcaactatcctgtaactggattggcctttcgccaagcaggaaagaccactcacttgtttgttgtgacaacagagaacgtccagtcctatatagtttctggaaaagactaccctcgcgtggagttggacacccatggttgtggcctgcgctgctcagccctaagtgacccttctcaggacctgcagttcattgtggccggggatgagtgtgtctacttgtaccagcctgatgaacgtgggccctgcttcgcctttgagggccataagctcattgcccactggtttagaggctaccttatcattgtctcccgtgaccggaaggtttctcccaagtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccgaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaagaattatcaggaagcccttcgatacatcggcaagctgccttttgagcaggcagagagcaacatgaagcgctacggcaagatcctcatgcaccacataccagagcagacaactcagttgctgaagggactttgtactgattatcggcccagcctcgaaggccgcagcgatagggaggccccaggctgcagggccaactctgaggagttcatccccatctttgccaataacccgcgagagctgaaagccttcctagagcacatgagtgaagtgcagccagactcaccccaggggatctacgacacactccttgagctgcgactgcagaactgggcccacgagaaggatccacaggtcaaagagaagcttcacgcagaggccatttccctgctgaagagtggtcgcttctgtgacgtctttgacaaggccctggtcctgtgccagatgcacgacttccaggatggtgtcctttacctttatgagcaggggaagctgttccagcagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctagtggtgcagaccctggcccacaactccacagccacactctccgtcatcagggactacctggtccaaaaactacagaaacagagccagcagattgcacaggatgagctgcgggtgcggcggtaccgagaggagaccacccgtatccgccaggagatccaagagctcaaggccagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatgatttgggaaaaaaagga

SEQ ID NO: 31921 - DNA, 2511 bp, Homo sapiens
caacagagaacgtccagtcctatatagcttctggagccctaagtgacccttctcaggacctgcagttcattgtggccggggatgagtgtgtctacttgtaccagcctgatgaacgtgggccctgcttcgcctttgagggccataagctcattgcccactggtttagaggctaccttatcattgtctcccgtgaccggaaggtttctcccaagtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccgaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaagaattatcaggaagcccttcgatacatcggcaagctgccttttgagcaggcagagagcaacatgaagcgctacggcaagatcctcatgcaccacataccagagcagacaactcagttgctgaagggactttgtactgattatcggcccagcctcgaaggccgcagcgatagggaggccccaggctgcagggccaactctgaggagttcatccccatctttgccaataacccgcgagagctgaaagccttcctagagcacatgagtgaagtgcagccagactcaccccaggggatctacgacacactccttgagctgcgactgcagaactgggcccacgagaaggatccacaggtcaaagagaagcttcacgcagaggccatttccctgctgaagagtggtcgcttctgtgacgtctttgacaaggccctggtcctgtgccagatgcacgacttccaggatggtgtcctttacctttatgagcaggggaagctgttccagcagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctagtggtgcagaccctggcccacaactccacagccacactctccgtcatcagggactacctggtccaaaaactacagaaacagagccagcagattgcacaggatgagctgcgggtgcggcggtaccgagaggagaccacccgtatccgccaggagatccaagagctcaaggccagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatgatttgggaaaaaaagga

SEQ ID NO: 31922 - DNA, 874 bp, Homo sapiens
cgatagcattgcgagacgctggagccggagcaccctatgtcgcagtatctgtctttgattcctgccccatcccattatttatcgcacctacgttcaatattacaggcgaacatacttactaaagtgtgttaattaattaatgcttgtaggacatagtaataacaattgaatgtctgcacagccgctttccacacagacatcataacaaaaaatttccaccaaacccccccctccccccgcttctggccacagcacttaaacacatctctgccaaaccccacaaagaaccctaactcgtgccgaattcggcacgaacagaaacgagatctccatgatcaattccagcatcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatgatttgggaaaaaaagga

SEQ ID NO: 31923 - DNA, 1941 bp, Homo sapiens
cccggaagctgccgaccacgtgattcgctggctcagctcacgtgacaaagctcccggaggtgggagccctgggccaaaatggcggcctacctgcagtggcggcgcttcgttttcttcgacaaggagctggtgaaggagccgctgagcaatgatggggccgctcccggggccacacctgcttctggatccgctgcttccaagttcctttgcctccctcctggcatcactgtctgcgactcaggccgagggagcctggtctttggagatatggaaggccagatctggttcttgccacgttccctacagcttacaggcttccaagcctacaaactacgggtgacacacctgtaccaactgaagcagcacaatattctggcatctgttggagaagatgaagagggcatcaaccccttggttaagatctggaacctggagaagagagatggtggcaatccactctgcactcgaatcttccctgctattccaggaacagagccaactgttgtatcttgtttgactgtccatgaaaatctcaactttatggccattggtttcacagatggcagtgttacattgaacaaaggagacatcacccgggaccggcatagcaagacccagattttgcacaagggcaactatcctgtaactggattggcctttcgccaagcaggaaagaccactcacttgtttgttgtgacaacagagaacgtccagtcctatatagtttctggaaaagactaccctcgcgtggagttggacacccatggttgtggcctgcgctgctcagccctaagtgacccttctcaggacctgcagttcattgtggccggggatgagtgtgtctacttgtaccagcctgatgaacgtgggccctgcttcgcctttgagggccataagctcattgcccactggtttagaggctaccttatcattgtctcccgtgaccggaaggtttctcccaagtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccgaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaagaattatcaggaagcccttcgatacatcggcaagctgccttttgagcaggcagagagcaacatgaagcgctacggcaagatcctcatgcaccacataccagagcagacaactcagttgctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatgatttgggaaaaaaagga

SEQ ID NO: 31924 - DNA, 131 bp, Homo sapiens
cttgtgggagcaggccctcagctacttcgctcgcaaggaggaggactgcaaggagtatgtggcagctgtcctcaagcatatcgagaacaagaacctcatgccacctcttctaggtacttgggaagacagat

SEQ ID NO: 31925 - DNA, 503 bp, Homo sapiens
ttcattcagttccaggcacagtgttttacatataccatgtattggattattattttctaaatgaatggatatgttagtgtacttaattttctaatctgttacttgggttaattgtaggatcctaaagggtaagatcaggtttatgtgttctctatgtacaactaccggcacagcgctgcatgttatgggatgagagggaccagagaggtgatttgtgctgggtgaaatgtgcaccaaagttatcatgggaaaggaaataggggagataagacagagatgtccaaacatctggtgctttttctttcctatgcaggtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacag

SEQ ID NO: 31926 - DNA, 363 bp, Homo sapiens
ggaggtgggagccctgggccaaaatggcggcctacctgcagtggcggcgcttcgttttcttcgacaaggagctggtgaaggagccgctgagcaatgatggggccgctcccggggccacacctgcttctggatccgctgcttccaagttcctttgcctccctcctggcatcactgtctgcgactcaggccgagggagcctggtctttggagatatccttcgtttggagctgtcttttccctcccgggatcccgaagagatcgagttaggatgaaatctgtttgtcggaggggtccgtgccgcgcgcctctttggtttagctggtcatccagagttgttctgtggtctacgggaagaaagaagga

SEQ ID NO: 31927 - DNA, 3014 bp, Homo sapiens
cccggaagctgccgaccacgtgattcgctggctcagctcacgtgacaaagctcccggaggtgggagccctgggccaaaatggcggcctacctgcagtggcggcgcttcgttttcttcgacaaggagctggtgaaggagccgctgagcaatgatggggccgctcccggggccacacctgcttctggatccgctgcttccaagttcctttgcctccctcctggcatcactgtctgcgactcaggccgagggagcctggtctttggagatatggaaggccagatctggttcttgccacgttccctacagcttacaggcttccaagcctacaaactacgggtgacacacctgtaccaactgaagcagcacaatattctggcatctgttggagaagatgaagagggcatcaaccccttggttaagatctggaacctggagaagagagatggtggcaatccactctgcactcgaatcttccctgctattccaggaacagagccaactgttgtatcttgtttgactgtccatgaaaatctcaactttatggccattggtttcacagatggcagtgttacattgaacaaaggagacatcacccgggaccggcatagcaagacccagattttgcacaagggcaactatcctgtaactggattggcctttcgccaagcaggaaagaccactcacttgtttgttgtgacaacagagaacgtccaggtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccgaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaagaattatcaggaagcccttcgatacatcggcaagctgccttttgagcaggcagagagcaacatgaagcgctacggcaagatcctcatgcaccacataccagagcagacaactcagttgctgaagggactttgtactgattatcggcccagcctcgaaggccgcagcgatagggaggccccaggctgcagggccaactctgaggagttcatccccatctttgccaataacccgcgagagctgaaagccttcctagagcacatgagtgaagtgcagccagactcaccccaggggatctacgacacactccttgagctgcgactgcagaactgggcccacgagaaggatccacaggtcaaagagaagcttcacgcagaggccatttccctgctgaagagtggtcgcttctgtgacgtctttgacaaggccctggtcctgtgccagatgcacgacttccaggatggtgtcctttacctttatgagcaggggaagctgttccagcagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctagtggtgcagaccctggcccacaactccacagccacactctccgtcatcagggactacctggtccaaaaactacagaaacagagccagcagattgcacaggatgagctgcgggtgcggcggtaccgagaggagaccacccgtatccgccaggagatccaagagctcaaggccagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatgatttgggaaaaaaagga

SEQ ID NO: 31928 - DNA, 2415 bp, Homo sapiens
  misc_feature (2145)..(2145): n is a, c, g, or t
  misc_feature (2153)..(2153): n is a, c, g, or t
  misc_feature (2159)..(2159): n is a, c, g, or t
  misc_feature (2162)..(2163): n is a, c, g, or t
  misc_feature (2165)..(2165): n is a, c, g, or t
  misc_feature (2172)..(2172): n is a, c, g, or t
  misc_feature (2174)..(2174): n is a, c, g, or t
  misc_feature (2184)..(2184): n is a, c, g, or t
  misc_feature (2191)..(2191): n is a, c, g, or t
  misc_feature (2193)..(2193): n is a, c, g, or t
  misc_feature (2202)..(2202): n is a, c, g, or t
  misc_feature (2204)..(2204): n is a, c, g, or t
  misc_feature (2219)..(2219): n is a, c, g, or t
  misc_feature (2225)..(2225): n is a, c, g, or t
  misc_feature (2237)..(2237): n is a, c, g, or t
  misc_feature (2246)..(2249): n is a, c, g, or t
  misc_feature (2252)..(2252): n is a, c, g, or t
  misc_feature (2255)..(2255): n is a, c, g, or t
  misc_feature (2265)..(2265): n is a, c, g, or t
  misc_feature (2280)..(2280): n is a, c, g, or t
  misc_feature (2291)..(2291): n is a, c, g, or t
  misc_feature (2297)..(2297): n is a, c, g, or t
  misc_feature (2308)..(2308): n is a, c, g, or t
  misc_feature (2322)..(2322): n is a, c, g, or t
  misc_feature (2339)..(2339): n is a, c, g, or t
  misc_feature (2370)..(2370): n is a, c, g, or t
cccggaagctgccgaccacgtgattcgctggctcagctcacgtgacaaagctcccggaggtgggagccctgggccaaaatggcggcctacctgcagtggcggcgcttcgttttcttcgacaaggagctggtgaaggagccgctgagcaatgatggggccgctcccggggccacacctgcttctggatccgctgcttccaagttcctttgcctccctcctggcatcactgtctgcgactcaggccgagggagcctggtctttggagatatggaaggccagatctggttcttgccacgttccctacagcttacaggcttccaagcctacaaactacgggtgacacacctgtaccaactgaagcagcacaatattctggcatctgttggagaagatgaagagggcatcaaccccttggttaagatctggaacctggagaagagagatggtggcaatccactctgcactcgaatcttccctgctattccaggaacagagccaactgttgtatcttgtttgactgtccatgaaaatctcaactttatggccattggtttcacagatggcagtgttacattgaacaaaggagacatcacccgggaccggcatagcaagacccagattttgcacaagggcaactatcctgtaactggattggcctttcgccaagcaggaaagaccactcacttgtttgttgtgacaacagagaacgtccagtcctatatagtttctggaaaagactaccctcgcgtggagttggacacccatggttgtggcctgcgctgctcagccctaagtgacccttctcaggacctgcagttcattgtggccggggatgagtgtgtctacttgtaccagcctgatgaacgtgggccctgcttcgcctttgagggccataagctcattgcccactggtttagaggctaccttatcattgtctcccgtgaccggaaggtttctcccaagtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccgaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaagaattatcaggaagcccttcgatacatcggcaagctgccttttgagcaggcagagagcaacatgaagcgctacggcaagatcctcatgcaccacataccagagcagacaactcagttgctgaagggactttgtactgattatcggcccagcctcgaaggccgcagcgatagggaggccccaggctgcagggccaactctgaggagttcatccccatctttgccaataacccgcgagagctgaaagccttcctagagcacatgagtgaagtgcagccagactcaccccaggggatctacgacacactccttgagctgcgactgcagaactgggcccacgagaaggatccacaggtcaaagagaagcttcacgcagaggccatttccctgctgaagagtggtcgcttctgcgacgtctttgacaaggcctggtcctgtgccagatgcacgacttccaggatggtgtcctttacctttatgagcaggggaagctgttcnagcagatnatgcantannanatgcagnangggcagtacnggcaggncnatcaaaatntntaaaaaaaaaggggngaaggnaaaataattgtnggggaaggnnnncgntcnttcgctcgcncgggggggggctgcncggggtttgtngccgcngttctcccgcntttcgcgcccccgnccctcctgccccccctnctcgtggtgcggccctggccccccctccccngccccctctccgtctccggggttcttgtccccccctccgccccgg

SEQ ID NO: 31929 - DNA, 384 bp, Homo sapiens
gaagcttcacgcagaggccatttccctgctgaagagtggtcgcttctgtgacgtctttgacaaggccctggtcctgtgccagatgcacgacttccaggatggtgtcctttacctttatgagcaggggaagctgtaagagtttggggaatttcagggaaaggggaagaatccaagtcattttccagagacagccactgaggtgtgcccttgccccggccgcaggttccagcagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcct

SEQ ID NO: 31930 - DNA, 2188 bp, Homo sapiens
ttttttttttgtgtgtgtgtgtgtgtgtgtatgtgtcaggactggattatagcaccagaaggatacgctgcattttattgtgatggagaatgttcttttccacttaacgcccatatgaatgccaccaaccacgctatagttcagactctggttcatctgatgtttcctgaccacgtaccaaagccttgttgtgctccaaccaaattaaatgccatctctgttctgtactttgatgacagctccaatgtcattttgaaaaaatatagaaatatggtagtacgctcatgtggctgccactaatattaaataatattgataataacaaaaagatctgtattaaggtttatggctgcaataaaaagcatactttcagacaaacggggaatttcctaaaattagtctggctcattttgactcttttcctatgtacaatatcatgtatatagtcatttttatttatttaaacgtatatattctcttctgtggaggctttatcaataaaatctatttcataggccactacattatacaatagatcatctagtataattttcaatgggttatgctgagtccattcaattccatttcaacatttttttctaatacaattttacataattttctgagattagacagaactcctttgactgtttaatattgtggaaggaaattgaataatttagttatattgtgccaatgaaaaccatgatagaatatttatttagaaataagacttaaaaaaataacaacccaaacaaaaattcttggataaacacaatttctcttttagagttcctgcttcattagataaagtgaaatgttgaactggatttgaataaataaacggtaggcagaacatagaagctgaaagattgcacagaattgttttaactgtttgctttaacagaagtggtgtaactgtaggagcatgttcctttttggcttgtggattgtagattttgcaaagagctcaaagcttcaggagacaggcttgagcctgtgtccatagctttccaagttaacactaattgtagtacaaccttcttacctcaaataaatcatgtctgcctattatctagaacactactgctgcagaatttttttttcagatttaaaaacctagtccaaaataaagaaacatttacatgtgctccactttcctccccacaggcaagagtcactgcatgcgtaaaatgtacaagagcagaagatgccgaaagaaccattttctttagctctcctttataactgagtttgctgattgatgtgatgcaagggattttatttagaagtaaaagcactgaaactaaactggaggaaattaccaaaagtcccagaatggctttgacagaattgccatttctaaagaacagctgaaattcatttttcatatctttgagagtgagctcaatgaaaaccttattttgtaaaggcattttgtaaaccttcttccaagcacaaataattccaaacaggaaggttctgtttgtgtgtgtgtgtgtgtgtgtctgtgtgtgcatgtgtgttcttccctctaaaattaatttattttctctatctattagaatgccctctaaggcctttctttaacacacactgactttttgaagaatgatctttagattgataacttgctatttatggtgactctgtggttaggcttatttaccgttaatctaaagtattcataaagcaccatttattaatcatccttttggatctttcaaaccaaacgtataccaaaaatgtcttcaaaaatgttatggctttgtttgtaattcgggtatattaaaatgttgttttgaaatacagtttatcttaaagaaaatttgacagtaactatattaaggggtacattaagtaatatatttttaattaatggtgtaccattgagagaataagaaatggaagtctattgttttattctttaaatgtgctgtttaaatatatttccatattttaaaatatattaaacagatgctaatttctgctgttcttgatttggttctttatttaaaaggaatacaaaatgtaagtatatcataaattgagacaataagaatatttatcaaatgtaaactgtggatcacatgattctttatgttgttcttaattgccaaaattgttttttgtgttgttaataattatctcactattaaatgtgcaaagcaacaatccatgaattaaa

SEQ ID NO: 31931 - DNA, 3782 bp, Homo sapiens
tactctttagatctctcttgaagagggctggtatatttgtgcctgctggaggtggaattaacagtaagaaggagaaagggattgaatggacttacaggaaggatttcaagtaaattcagggaaacacatttacttgaatagtacaacctagagtattattttacactaagacgacacaaaagatgttaaagttatcaccaagctgccggacagatatatattccaacaccaaggtgcagatcagcatagatctgtgattcagaaatcaggatttgttttggaaagagctcaagggttgagaagaactcaaaagcaagtgaagattactttgggaactacagtttatcagaagatcaacttttgctaattcaaataccaaaggcctgattatcataaattcatataggaatgcataggtcatctgatcaaataatattagccgtcttctgctacatcaatgcagcaaaaactcttaacaactgtggataattggaaatctgagtttcagctttcttagaaataactactcttgacatattccaaaatatttaaaataggacaggaaaatcggtgaggatgttgtgctcagaaatgtcactgtcatgaaaaataggtaaatttgttttttcagctactgggaaactgtacctcctagaaccttaggttttttttttttttaagaggacaagaaggactaaaaatatcaacttttgcttttggacaaaaatgcatctgactgtatttttacttaagggtattgtgggtttcctctggagctgctgggttctagtgggttatgcaaaaggaggtttgggagacaatcatgttcactccagttttatttatagaagactacggaaccacgaaagacgggaaatacaaagggaaattctctctatcttgggtttgcctcacagacccagaccattttcacctggaaaacaagcgtcctctgcacctctctttatgctggatctctacaatgccatgaccaatgaagaaaatcctgaagagtcggattgaaagagacaaggatttttctcaccagcgaaggcattacaaagaatttcgatttgatcttacccaaattcctcatggagaggcagtgacagcagctgaattccggatatacaaggaccggagcaacaaccgatttgaaaatgaaacaattaagattagcatatatcaaatcatcaaggaatacacaaatagggatgcagatctgttcttgttagacacaagaaaggcccaagctttagatgtgggttggcttgtctttgatatcactgtgaccagcaatcattgggtgattaatccccagaataatttgggcttacagctctgtgcagaaacaggggatggacgcagtatcaacgtaaaatctgctggtcttgtgggaagacagggacctcagtcaaaacaaccattcatggtggccttcttcaaggcgagtgaggtacttcttcgatccgtgagagcagccaacaaacgaaaaaatcaaaaccgcaataaatccagctctcatcaggactcctccagaatgtccagtgttggagattataacacaagtgagcaaaaacaagcctgtaagaagcacgaactctatgtgagcttccgggatctgggatggcaggactggattatagcaccagaaggatacgctgcattttattgtgatggagaatgttcttttccacttaacgcccatatgaatgccaccaaccacgctatagttcagactctggttcatctgatgtttcctgaccacgtaccaaagccttgttgtgctccaaccaaattaaatgccatctctgttctgtactttgatgacagctccaatgtcattttgaaaaaatatagaaatatggtagtacgctcatgtggctgccactaatattaaataatattgataataacaaaaagatctgtattaaggtttatggctgcaataaaaagcatactttcagacaaacggggaatttcctaaaattagtctggctcattttgactcttttcctatgtacaatatcatgtatatagtcatttttatttatttaaacgtatatattctcttctgtggaggctttatcaataaaatctatttcataggccactacattatacaatagatcatctagtataattttcaatgggttatgctgagtccattcaattccatttcaacatttttttctaatacaattttacataattttctgagattagacagaactcctttgactgtttaatattgtggaaggaaattgaataatttagttatattgtgccaatgaaaaccatgatagaatatttatttagaaataagacttaaaaaaataacaacccaaacaaaaattcttggataaacacaatttctcttttagagttcctgcttcattagataaagtgaaatgttgaactggatttgaataaataaacggtaggcagaacatagaagctgaaagattgcacagaattgttttaactgtttgctttaacagaagtggtgtaactgtaggagcatgttcctttttggcttgtggattgtagattttgcaaagagctcaaagcttcaggagacaggcttgagcctgtgtccatagctttccaagttaacactaattgtagtacaaccttcttacctcaaataaatcatgtctgcctattatctagaacactactgctgcagaatttttttttcagatttaaaaacctagtccaaaataaagaaacatttacatgtgctccactttcctccccacaggcaagagtcactgcatgcgtaaaatgtacaagagcagaagatgccgaaagaaccattttctttagctctcctttataactgagtttgctgattgatgtgatgcaagggattttatttagaagtaaaagcactgaaactaaactggaggaaattaccaaaagtcccagaatggctttgacagaattgccatttctaaagaacagctgaaattcatttttcatatctttgagagtgagctcaatgaaaaccttattttgtaaaggcattttgtaaaccttcttccaagcacaaataattccaaacaggaaggttctgtttgtgtgtgtgtgtgtgtgtgtctgtgtgtgcatgtgtgttcttccctctaaaattaatttattttctctatctattagaatgccctctaaggcctttctttaacacacactgactttttgaagaatgatctttagattgataacttgctatttatggtgactctgtggttaggcttatttaccgttaatctaaagtattcataaagcaccatttattaatcatccttttggatctttcaaaccaaacgtataccaaaaatgtcttcaaaaatgttatggctttgtttgtaattcgggtatattaaaatgttgttttgaaatacagtttatcttaaagaaaatttgacagtaactatattaaggggtacattaagtaatatatttttaattaatggtgtaccattgagagaataagaaatggaagtctattgttttattctttaaatgtgctgtttaaatatatttccatattttaaaatatattaaacagatgctaatttctgctgttcttgatttggttctttatttaaaaggaatacaaaatgtaagtatatcataaattgagacaataagaatatttatcaaatgtaaactgtggatcacatgattctttatgttgttcttaattgccaaaattgttttttgtgttgttaataattatctcactattaaatgtgcaaagcaacaatccatgaattaaa

SEQ ID NO: 31932 - DNA, 3979 bp, Homo sapiens
tactctttagatctctcttgaagagggctggtatatttgtgcctgctggaggtggaattaacagtaagaaggagaaagggattgaatggacttacaggaaggatttcaagtaaattcagggaaacacatttacttgaatagtacaacctagagtattattttacactaagacgacacaaaagatgttaaagttatcaccaagctgccggacagatatatattccaacaccaaggtgcagatcagcatagatctgtgattcagaaatcaggatttgttttggaaagagctcaagggttgagaagaactcaaaagcaagtgaagattactttgggaactacagtttatcagaagatcaacttttgctaattcaaataccaaaggcctgattatcataaattcatataggaatgcataggtcatctgatcaaataatattagccgtcttctgctacatcaatgcagcaaaaactcttaacaactgtggataattggaaatctgagtttcagctttcttagaaataactactcttgacatattccaaaatatttaaaataggacaggaaaatcggtgaggatgttgtgctcagaaatgtcactgtcatgaaaaataggtaaatttgttttttcagctactgggaaactgtacctcctagaaccttaggttttttttttttttaagaggacaagaaggactaaaaatatcaacttttgcttttggacaaaaatgcatctgactgtatttttacttaagggtattgtgggtttcctctggagctgctgggttctagtgggttatgcaaaaggaggtttgggagacaatcatgttcactccagttttatttatagaagactacggaaccacgaaagacgggaaatacaaagggaaattctctctatcttgggtttgcctcacagacccagaccattttcacctggaaaacaagcgtcctctgcacctctctttatgctggatctctacaatgccatgaccaatgaagaaaatcctgaagagtcggagtactcagtaagggcatccttggcagaagagaccagaggggcaagaaagggatacccagcctctcccaatgggtatcctcgtcgcatacagttatctcggacgactcctctgaccacccagagtcctcctctagccagcctccatgataccaactttctgaatgatgctgacatggtcatgagctttgtcaacttagttgaaagagacaaggatttttctcaccagcgaaggcattacaaagaatttcgatttgatcttacccaaattcctcatggagaggcagtgacagcagctgaattccggatatacaaggaccggagcaacaaccgatttgaaaatgaaacaattaagattagcatatatcaaatcatcaaggaatacacaaatagggatgcagatctgttcttgttagacacaagaaaggcccaagctttagatgtgggttggcttgtctttgatatcactgtgaccagcaatcattgggtgattaatccccagaataatttgggcttacagctctgtgcagaaacaggggatggacgcagtatcaacgtaaaatctgctggtcttgtgggaagacagggacctcagtcaaaacaaccattcatggtggccttcttcaaggcgagtgaggtacttcttcgatccgtgagagcagccaacaaacgaaaaaatcaaaaccgcaataaatccagctctcatcaggactcctccagaatgtccagtgttggagattataacacaagtgagcaaaaacaagcctgtaagaagcacgaactctatgtgagcttccgggatctgggatggcaggactggattatagcaccagaaggatacgctgcattttattgtgatggagaatgttcttttccacttaacgcccatatgaatgccaccaaccacgctatagttcagactctggttcatctgatgtttcctgaccacgtaccaaagccttgttgtgctccaaccaaattaaatgccatctctgttctgtactttgatgacagctccaatgtcattttgaaaaaatatagaaatatggtagtacgctcatgtggctgccactaatattaaataatattgataataacaaaaagatctgtattaaggtttatggctgcaataaaaagcatactttcagacaaacggggaatttcctaaaattagtctggctcattttgactcttttcctatgtacaatatcatgtatatagtcatttttatttatttaaacgtatatattctcttctgtggaggctttatcaataaaatctatttcataggccactacattatacaatagatcatctagtataattttcaatgggttatgctgagtccattcaattccatttcaacatttttttctaatacaattttacataattttctgagattagacagaactcctttgactgtttaatattgtggaaggaaattgaataatttagttatattgtgccaatgaaaaccatgatagaatatttatttagaaataagacttaaaaaaataacaacccaaacaaaaattcttggataaacacaatttctcttttagagttcctgcttcattagataaagtgaaatgttgaactggatttgaataaataaacggtaggcagaacatagaagctgaaagattgcacagaattgttttaactgtttgctttaacagaagtggtgtaactgtaggagcatgttcctttttggcttgtggattgtagattttgcaaagagctcaaagcttcaggagacaggcttgagcctgtgtccatagctttccaagttaacactaattgtagtacaaccttcttacctcaaataaatcatgtctgcctattatctagaacactactgctgcagaatttttttttcagatttaaaaacctagtccaaaataaagaaacatttacatgtgctccactttcctccccacaggcaagagtcactgcatgcgtaaaatgtacaagagcagaagatgccgaaagaaccattttctttagctctcctttataactgagtttgctgattgatgtgatgcaagggattttatttagaagtaaaagcactgaaactaaactggaggaaattaccaaaagtcccagaatggctttgacagaattgccatttctaaagaacagctgaaattcatttttcatatctttgagagtgagctcaatgaaaaccttattttgtaaaggcattttgtaaaccttcttccaagcacaaataattccaaacaggaaggttctgtttgtgtgtgtgtgtgtgtgtgtctgtgtgtgcatgtgtgttcttccctctaaaattaatttattttctctatctattagaatgccctctaaggcctttctttaacacacactgactttttgaagaatgatctttagattgataacttgctatttatggtgactctgtggttaggcttatttaccgttaatctaaagtattcataaagcaccatttattaatcatccttttggatctttcaaaccaaacgtataccaaaaatgtcttcaaaaatgttatggctttgtttgtaattcgggtatattaaaatgttgttttgaaatacagtttatcttaaagaaaatttgacagtaactatattaaggggtacattaagtaatatatttttaattaatggtgtaccattgagagaataagaaatggaagtctattgttttattctttaaatgtgctgtttaaatatatttccatattttaaaatatattaaacagatgctaatttctgctgttcttgatttggttctttatttaaaaggaatacaaaatgtaagtatatcataaattgagacaataagaatatttatcaaatgtaaactgtggatcacatgattctttatgttgttcttaattgccaaaattgttttttgtgttgttaataattatctcactattaaatgtgcaaagcaacaatccatgaattaaa

SEQ ID NO: 31933 - DNA, 1869 bp, Homo sapiens
tactctttagatctctcttgaagagggctggtatatttgtgcctgctggaggtggaattaacagtaagaaggagaaagggattgaatggacttacaggaaggatttcaagtaaattcagggaaacacatttacttgaatagtacaacctagagtattattttacactaagacgacacaaaagatgttaaagttatcaccaagctgccggacagatatatattccaacaccaaggtgcagatcagcatagatctgtgattcagaaatcaggatttgttttggaaagagctcaagggttgagaagaactcaaaagcaagtgaagattactttgggaactacagtttatcagaagatcaacttttgctaattcaaataccaaaggcctgattatcataaattcatataggaatgcataggtcatctgatcaaataatattagccgtcttctgctacatcaatgcagcaaaaactcttaacaactgtggataattggaaatctgagtttcagctttcttagaaataactactcttgacatattccaaaatatttaaaataggacaggaaaatcggtgaggatgttgtgctcagaaatgtcactgtcatgaaaaataggtaaatttgttttttcagctactgggaaactgtacctcctagaaccttaggttttttttttttttaagaggacaagaaggactaaaaatatcaacttttgcttttggacaaaaatgcatctgactgtatttttacttaagggtattgtgggtttcctctggagctgctgggttctagtgggttatgcaaaaggaggtttgggagacaatcatgttcactccagttttatttatagaagactacggaaccacgaaagacgggaaatacaaagggaaattctctctatcttgggtttgcctcacagacccagaccattttcacctggaaaacaagcgtcctctgcacctctctttatgctggatctctacaatgccatgaccaatgaagaaaatcctgaagagtcggagtactcagtaagggcatccttggcagaagagaccagaggggcaagaaagggatacccagcctctcccaatgggtatcctcgtcgcatacagttatctcggacgactcctctgaccacccagagtcctcctctagccagcctccatgataccaactttctgaatgatgctgacatggtcatgagctttgtcaacttagttgaaagagacaaggatttttctcaccagcgaaggcattacaaagaatttcgatttgatcttacccaaattcctcatggagaggcagtgacagcagctgaattccggatatacaaggaccggagcaacaaccgatttgaaaatgaaacaattaagattagcatatatcaaatcatcaaggaatacacaaatagggatgcagatctgttcttgttagacacaagaaaggcccaagctttagatgtgggttggcttgtctttgatatcactgtgaccagcaatcattgggtgattaatccccagaataatttgggcttacagctctgtgcagaaacaggggatggacgcagtatcaacgtaaaatctgctggtcttgtgggaagacagggacctcagtcaaaacaaccattcatggtggccttcttcaaggcgagtgaggtacttcttcgatccgtgagagcagccaacaaacgaaaaaatcaaaaccgcaataaatccagctctcatcaggactcctccagaatgtccagtgttggaggtaagaataaacccgagcagcagttatgcacagagagttatggggtcgtatgctgcaaatcaagtagccacaataaatttaccctctatgtataccttcggatggtacattaaatc

SEQ ID NO: 31934 - DNA, 4104 bp, Homo sapiens
tggtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcatcccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31935 - DNA, 1738 bp, Homo sapiens
ggcatatgaagcttatgactgtcataagccataccaagcctgtggagtatggcatgattttcattacataatccaatgaaaatagacttattttaaatccctaactttgtagttttaatttgtatttcactatcttgaaattaacagctagtacttatccatcacagcagtctcctactgacatgaagcaagttgttgaatgcagtagagcatgaatgaaagcatttaatgtagacaaaaatgggtgatacccaagcattctgaattatttgcatcaaggaatggacatgtacataagtggcatcatttctaccaatatgtgacttgagttgtttttttaaaaaaaggagaatgactttctcaaatttgcattaaagaagtttttaagaatgttcaaatggcatgctgctttgtctggacgtgaatttattagcaagtagtaaagcacttcactaaaggaccatgaatttttgtggtttcatggattctctcttgaagggtacttttatttttttaatataattcagaaactcagaaggtaggtatgaaatattggtaggtgtttctcgcaccttcagaaagtattggaccggtcttattattataattttaacaaaatatttccaatttttgtgcttttgacatgcataaatgaccaaagttaaagggagtagtttttatcttttctaatgtgcttgaatcgaaactctctgtgcctaattaaaaagaacattaacaaactggaagcagatcttcccactgatccataatgtggtatgcatttattctgctgttcagtcagaacatttaaatcatctatgaggaatcacaaaacctctcaaagagcaataaatactttccaaccacttgggaatttaaatgaagattgaacaatagtaggggaaaaactgctgtggttctactgggaacttgcttttccttctagatgccaagtgctttaaattctaaatgtactaaatccaggagaagattttccaagtagagactgaatgaatctttgtaactaatgggaacatgattagtcacatttccaggcagctagtcaagaagtattgtttcagcgatttttcaggtagatggttttgatttgtctgttttccttttggtcctctctaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31936 - DNA, 642 bp, Homo sapiens
agcacttcagtatgtcaactctacggggaaacagaaagcttcagggaacactcttctgcttctcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31937 - DNA, 447 bp, Homo sapiens
ttttttcacattcacagactctgtttattttcatcctattcaaaacagatacatctttgaacacaaaggatgccagagaatcctgtttatcaataactgtcagatgacagatgattcagagtattatgtgacagccggtgatgagaaatgttccactgagctcttcgtaagaggtaaaaatgaaatctcttattgtggtcaccaggagctgttggcttcttctcccagggataatgatcaaagtgaaagtaactgaggctcctctacactggcagctattatggatcctaatgagtcttctggtttgttgaagaagaattaatgctggaagtgttgtggcttgtgaactgttgtgaagcagtagaaagaggattattcaaaatctgatgagtagttgtgacctcagatgtaaatgggtgtggcttatatcacatggatgaactgagg

SEQ ID NO: 31938 - DNA, 575 bp, Homo sapiens
ttttttcacattcacagactctgtttattttcatcctattcaaaacagatacatctttgaacacaaaggatgccagagaatcctgtttatcaataactgtcagatgacagatgattcagagtattatgtgacagccggtgatgagaaatgttccactgagctcttcgtaagaggtaaaaatgaaatctcttattgtggtcaccaggagctgttggcttcttctcccagggataatgatcaaagtgaaagtaactgaggctcctctacactggcagctattatggatcctaatgagtcttctggtttgttgaagacctgatagcagcactctggtcattgatatagctgaaagagatgactctggtgtttaccacatcaatctgaaaaacgaagctggagaggcacatgcaagcatcaaggttaaagttgtgggtaagtcctccaggtaaacgcacttctagaatcaagctgacatgtcaagattcagagtagactttccttctttgtcctttccttccatttccttcctttgtctttcccttatcttctttttttttcttgcctagaggacaaat

SEQ ID NO: 31939 - DNA, 367 bp, Homo sapiens
  misc_feature (335)..(335): n is a, c, g, or t
ttttttcacattcacagactctgtttattttcatcctattcaaaacagatacatctttgaacacaaaggatgccagagaatcctgtttatcaataactgtcagatgacagatgattcagagtattatgtgacagccggtgatgagaaatgttccactgagctcttcgtaagaggtaaaaatgaaatctcttattgtggtcaccaggagctgttggcttcttctcccagggataatgatcaaagtgaaagtaactgaggctcctctacactggcagctattatggatcctaatgagtcttctggtttgttgaagagacgcataaggtggccgcggncaacccccgaccctcccaccaccttccacccc

SEQ ID NO: 31940 - DNA, 656 bp, Homo sapiens
tggtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcaggtgagcgcaagcccagagaaggcatcctgacctcatcctaatacaatcactaatgagctcatttcttgaagctgtattgattctaatccttgtcttattcagattgtagtttttacggcaatctttcattacgtttcctcttacaagaaaactaatgtattgagaaacaattaattttgcatgatacacacgcattcaaggatctagccaaaaataccacaggtttgttctatcatttttaatatttagcaaatacacagagatcaatcttcattttggggatgtactaaagttagataataattcacatttttatagaactttacatacagataataaaacattttcaaatgcatcctatcagctgtagctcctg

SEQ ID NO: 31941 - DNA, 649 bp, Homo sapiens
ttatatggagatagtctcattttagaaaataatcttaatcatatacttctgttactccatgaaatgctaattcctttgtctcaccatggaagaaatgattatcattactgaccatctgtcttaagctaaggagcattagtctttcatagagggaagtttcatgaaggtggattagacagctttgctgtatatgtttgtattgtcattttaaaagtgaaccttttatttgcataatgaataaaaaagtttaaattttggaataactatttcctgactgcaacaagaagtttctctttttcctggacactgctcaaaaccatgttaagtatctctttgttcttgatgtgtcatatttcattatctaatttctatgatattcttgtgtcctatacattagtaaaatacttttttctttctttcagtagattggattactttccttcagctaacttgaacttatgctctcataatgaacgcataacgttagtatactcactttgtccttgaccttcagtggctcccatggagagtaacatgaatactaatcctggccacgtgggcgcagtttgaaggttatttgcttatggaatgcagacagtgcaaactcctagaactccttccatgggatggtttcaaggaggtttgggca

SEQ ID NO: 31942 - DNA, 4179 bp, Homo sapiens
tggtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcatcccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31943 - DNA, 4307 bp, Homo sapiens
aatgtagttgtatcgatgtggccttatagtccatcacctagaaaaacaccaagagtactgcttgaatacactggccaccattgtttacctgttaggggacaggcaagatggggaagcaaaggaattattgccatcaaagagagaataacagcttacctggaaagttccactatttctaagaattacataatgttcatttgccccatcatggaagagatacccctgtaagaatgggaatctgttcccctctactgatggctgctgggggcagaaagaatgatgttgtatttatctaggtttattagacaaagaaaagctacagcgttggtgagaacaacaaatccaggtaagactgcctaagaagagcctggccctgaaataatccttttcctcctttctgctcatcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcatcccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31944 - DNA, 4026 bp, Homo sapiens
tggtcacaccgacctgcaccatctctcgcctgcctgtggggtttctgtcaactagtcgtggagggaaggagactctttaaagaataacatcttattgtggccatgccagaacccactaagaaagaggactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcatcccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31945 - DNA, 3243 bp, Homo sapiens
cacatcaatctgaaaaacgaagctggagaggcacatgcaagcatcaaggtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcatcccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31946 - DNA, 4136 bp, Homo sapiens
tggtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcatcccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31947 - DNA, 2582 bp, Homo sapiens
ttttttcacattcacagactctgtttattttcatcctattcaaaacagatacatctttgaacacaaaggatgccagagaatcctgtttatcaataactgtcagatgacagatgattcagagtattatgtgacagccggtgatgagaaatgttccactgagctcttcgtaagaggtaaaaatgaaatctcttattgtggtcaccaggagctgttggcttcttctcccagggataatgatcaaagtgaaagtaactgaggctcctctacactggcagctattatggatcctaatgagtcttctggtttgttgaagacctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcatcccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31948 - DNA, 2540 bp, Homo sapiens
  misc_feature (2464)..(2464): n is a, c, g, or t
  misc_feature (2469)..(2469): n is a, c, g, or t
  misc_feature (2497)..(2497): n is a, c, g, or t
  misc_feature (2500)..(2500): n is a, c, g, or t
  misc_feature (2514)..(2514): n is a, c, g, or t
tggtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagaggantgganagttgcaaatgtttatttgaatcttatnaanttctgcaccatccntcttccaagttaaatctggtcttggg

SEQ ID NO: 31949 - DNA, 1279 bp, Homo sapiens
tggtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaaggtgagtaaaaacactcactcacacacgtttgggctgcaaatacagagggtccatcccagcatgatttggcctccacgggtgctgtgagctgtgagctttaacctaactcctactgagaagttggatggtgaccattgtgataagttgagaataataaaaataatacactgtgtttatataatcctcttgtgttaatctaatttggatggcacttcatatatattagggggacaattcttatgaaacctttcaaattatgtaaaagttattatgtccgcattttacagtgtggaggctgagcctccatccaaggggctgaagaatttgtgaggctttttcctatatagtgaaggtcaaacaaacccacatcttctttatgagagtggggagtggatccatctctaccctggaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31950 - DNA, 1251 bp, Homo sapiens
aacagctttcaaaagaggaaaaaagtaaggttcttttttgaaagctttgtagattgtatatagaatagctttgtaacataaggttttgtgtctatttagatcagtcatatatattccatgcagaatacaatattatagaatacactagtctaatatttgtacttgataattttgccttttagaatttcaacatatatatatgtacactaacactttgtctattgtctatgtttttcttttgttgaaaaacacgatatatatatgttgtagggttttggtttttgtatttgttttaagctaatggtttggaagctcttaccatagatattcactatacaatcagaatgactttgccacctattcaggcaaagtagttgtgcatattaataaatgttttacatattaatgatccttttgacgtgactggatccccacccttcatttcatgtgcttctattttcctacatcttttacatgactaaggattaatgaaatcacctcttcataatcatgaccataatttcatccaacaagtactcaagtttggtgttagcactttattaatgcttacgacttctctctctctccctctttctcttttccttagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31951 - DNA, 783 bp, Homo sapiens
  misc_feature (46)..(46): n is a, c, g, or t
  misc_feature (51)..(51): n is a, c, g, or t
  misc_feature (75)..(75): n is a, c, g, or t
gaggggggtgaggctgagaccttcgagcagcaggcaatgttcttgnacagngcagattgaatgcaaactggaggngaaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31952 - DNA, 1426 bp, Homo sapiens
tggtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaagtcaaaattttaaaacgggagtctggtgg

SEQ ID NO: 31953 - DNA, 1466 bp, Homo sapiens
tggtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagaggtaaaaatgaaatctcttattgtggtcaccaggagctgttggcttcttctcccagggataatgatcaaagtgaaagtaactgaggctcctctacactggcagctattatggatcctaatgagtcttctggtttgttgaagaagaattaatgctggaagtgttgtggcttgtgaactgttgtgaagcagtagaaagaggattattcaaaatctgatgagtagttgtgacctcagatgtaaatgggtgtggcttatatcacatggatgaactgagg

SEQ ID NO: 31954 - DNA, 1190 bp, Homo sapiens
tggtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtaggtgagaacaaagtgatggagtgagacattgtggcctggaagtctttcagacacccactcagagaagtcaagtttaaagtggatgttcttcagagaatttttcatttctgaaaatgtgttttgcttatagaatataacagagttgactagaaagagagaaacaactgcatactaatcttttaaagcctttaacagttgcttttaaactttctttttaaatgtttcatgactcttcacctatttttttttaaatggggacgaagagatatgaaaactgagacataagacaaatacctagaaacctctaagactgcacatatgattttggtagaagtctgaaggtatacacattgtaagaggcagacctactttaatgtattatttatgatgtactgtatttctgcaagtctaagacaccactgct

SEQ ID NO: 31955 - DNA, 666 bp, Homo sapiens
tatgcttgtactttctacacagaaccaagtaaagagaaggaggccggaactacaccagcaaaaggtgagttggagggagggagagtgaggctgaagtcaacaaaattagaagcagaaagaagtcagtaatgattgtcatggtggctccatagaatttctctgcattatctttcgttctgcctttgcatcttatctgcaagtcccaatcagtataatgacaaatggtgcattgctaagtttccattacatgtatttctaaaagaaaaacaacaatgataaaaatatcacaagcacttgttgagatgccagcaaattaattggtagtttccaagtttcgacatgcatgctaagaaagagaggtgtttggtcttcttaggattatatcaattgggaaaattatctgaattacccggtttttttttaaattaaatgttttcatgttattgtgtgaactgttccagggttcactaataattttgaaggctagcatctcactttgtaacactgactatgtattcatgtagatttatataatgatttctacagatacacaatataacattaagaagacatgttgccccttcttgaactggaaactattcctgtaatattatcctatttttactttatatggagatagtctcattttagaaaataatcttaatc

SEQ ID NO: 31956 - DNA, 446 bp, Homo sapiens
taaatggggacgaagagatatgaaaactgagacataagacaaatacctagaaacctctaagactgcacatatgattccgtctcatgactgaataaatgaagccttcattctcttacctttgatatttagtcaaaaaatcagttttacgattttggtagaagtctgaaggtatacacattgtaagaggcagacctactttaatgtattatttatgatgtactgtatttctgcaagtctaagacaccactgctattaagatacaccagcactttataaatcactaagcaatgaaaaaattgttccaaatggtttgacacaccattgattataagatgcattgtcatttcagaggtctttaaaatgcctcaaaaatgtgttttagaagtgacaaaatggaaataaaagtttagtatcatcacacactgacacttttcattgttctctcc

SEQ ID NO: 31957 - DNA, 418 bp, Homo sapiens
aggatgccagagaatcctgtttatcaataactgtcagatgacagatgattcagagtattatgtgacagccggtgatgagaaatgttccactgagctcttcgtaagaggtaaaaatgaaatctcttattgtggtcaccaggagctgttggcttcttctcccagggataatgatcaaagtgaaagtaactgaggctcctctacactggcagctattatggatcctaatgagtcttctggtttgttgaagagactagaacagcagaggggagaaagagaacctgttgagtacaaatgcctcatgttttgactcaagccaagcactatcttgcaaaaataattattctagttatagctttgaaacccaacagattttactggataatccttgtttcacacactcaactgatcacaaataggt

SEQ ID NO: 31958 - DNA, 368 bp, Homo sapiens
agactctgaagtagccctgtttattgtgtaaatcatgccacattttgtttctccacttcttaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtgggtaagtcctccaggtaaacgcacttctagaatcaagctgacatgtcaagattcagagtagactttccttctttgtcctttccttccatttccttcctttgtctttcccttatcttctttttttttcttgcctagaggacaaatca

SEQ ID NO: 31959 - DNA, 290 bp, Homo sapiens
tactggtacaaatattctgattctgcagtgatatatcaaggagtaaatacccctggacaaccagtcttcctggaggggcagcaacagaggtttaaaaagtttatatcccactggatattctactttccgttccattcctcttacatgaaaatgcaccttgcatgtaaagcttgactttctcatttgcttttaattgtaccccttagcagctcatggcatacagtgcttatgccatgaacaaggaaggccaaattattcaaggatattaagtaatgtagaaactaagtttt

SEQ ID NO: 31960 - DNA, 533 bp, Homo sapiens
tggtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttgccaacattgcacagccaggctgggagcagcctagggagagcccccatcatgcccaccacccactctggcactggcttcatcctttacctatccccttccaccctcctttgctgcttaataaattctgaacttggtctccaaa

SEQ ID NO: 31961 - DNA, 4158 bp, Homo sapiens
tggtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcatcccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31962 - DNA, 4238 bp, Homo sapiens
tggtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcatcccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31963 - DNA, 4062 bp, Homo sapiens
tggtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcatcccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31964 - DNA, 3338 bp, Homo sapiens
tgctgttgcagttctcagataaaaagtgcaaacttgattctttggtatatctgactcagttgtgtggtgtcctttagttgcattgtaactgaagataacatggaacacatcagtggtgtggggttaggtctgtaatttgtcaggtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcatcccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31965 - DNA, 2225 bp, Homo sapiens
ccgtgttccctggggacccaagagaatcctcccctgctggggtggcagagacaggcacaaggatagactgtctcactgtgcgctgctcccccgcagattccaggacctgctcctctgttttcttcagggtcttgctttgttcttctctatctcttcttcccaccactggaggtgtcccagcctcctttctcctcttctctattcttttcttttttctcctcttctctgtggcaggtgcctcaggtcagaagccacagtctgcacagagcaggctgtgctctcctgaggaacccccctaacaccgtttggtctcttccgtcactgctctgaggacaaatctctttgcacactttgcatactttactaacagagaatgctgactgctgatacgatattattctggtgtgaaagtgggtgtctttaattaattttaatgacggattctcaaaggtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcatcccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31966 - DNA, 1484 bp, Homo sapiens
ttgctgtcttctcctttcagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaac

SEQ ID NO: 31967 - DNA, 295 bp, Homo sapiens
aagaggcaagaatgatccagatggtaatgaactagagtcagagacaggtgtgaactcaggttcagcttactatagatacaaagggttactgcaatggttaattgtaggtgtcaacttgactgggctaagagataccccaatcgctggtaaagcattatttctggtggtatctgtgagggtgtttccaaaagagataagcatttgaatcagtggactaagtatggaagatccaatctctctgtgggcaggcactatccaattggctgagggcccagacagaaaaaaaaaaggcaga

SEQ ID NO: 31968 - DNA, 632 bp, Homo sapiens
acagctatacaaattatgcgatgtgtatttcagcacatttatgttcccagtgtacttggatcacatgaggaagggagagaaaacgcaggttaacggtgaaaggaaagagactggatcagtgcctctccttaggaccaccagcggcctgttcctcccggggccctgtccatctctacaggtacaaacttgagtttggtagttcattccatgactgaaacgaatagaaggttttggcctaaaatgtattgacgcttatgcccacaaatggatatgtttccatgcttccatgtatcactgctgcttaaaatttttgcttttaaatgatcaaaatttaattagtggaaattttttaaataagtagtttaaatcttgagttttaaatccagtaggaaacctcacactcagtttttcacttctagtaggaggattttcttaaggcatgaggtatatttaataggatgtttgaatctctggatctgtattggtgctttatcctactcaaagcacttggaatgtatgcatttcattgagatgagtatatacacacttctgctatactactggaactactcacgacattttttacaattggtgatgaatcagcacaattaaaagcatctaaccgtcaccta

SEQ ID NO: 31969 - DNA, 271 bp, Homo sapiens
tggcagcttcaggacaccagtccaagccttatctatattgcaagtattgcataaaacctcagctgaaattttgataaattttatggaatttaagctagatagatcttgttcacctgaacatcctgtctgggatgcatggtagtagactgaacagctccactgcttatgaaatgtgtgacctcaggcaagttgttaagctcttggtgcttcatgtttatcattggcaaatggagatgataatagtacttatctcatgggattgttgtgtgga

SEQ ID NO: 31970 - DNA, 396 bp, Homo sapiens
gctccctgatggggagcatgctcagtttcctgcattcaggtacgagcagagacttggcaggatccgccccgttcagagttgcaggaagagccctggatgcctgtcgcaaattggaataagtgggagggagccacaggctggtacagaattgaagtctggaatacataaagtgtgttaatattaagtgcaacttcgtgaccttttaattgaggtattactgtgtaaccatcaccagattaatatatggaacatcataagtaccctgggagactccttgtgctatttcccactcagtgctctcctcttaaagaggtcagcactgttccggttcttctattaccatatatttgttttgcctgctcatgaacttcaaataaataaaaactatggtatgta

SEQ ID NO: 31971 - DNA, 893 bp, Homo sapiens
agaaatatgtaaccatgtaactgttgactgatcctagctctggcctgtgaactatagttttcattttgctgatttaattttctgttaatttcatcagtgtttttactagagggaatgcaacctacagtgtttttagtagagggaatgcaacctattttagttttttttcattcactctacccttacctatcataaatcacaaacttacatcataggtccccaattgcataagcattctaaagataaatttgggcattaggaagaggagttagaaagtgttttctgcttggaatcacaatgtggtgaaacatattccaccacagttacaatccatgtgactatttattaatacacattggactgtccaaaagcccacccaagccagtagcccacaatattagttcctcagataccaaagaagaagagggaggcctcatctgtgtgaaacctatataggaataaatgtcttctcccaagacgaggctacaaaagtcctatatcttctgaaactgcacatgatataaaaatagaatgactagctgaaaaatgtattatgtactatttgagaaaataaacactaaacattttgagagtaaattggtacccactttactgaaagtcattcagatctaaaggagagacatcaatctggtgatgaccgtggtcatggaaagatgaatttacttccccaaagtgacttactatcttactgagtcaccctaggcattgagctttatattagaccactacttattaggaaacttctttatctacctagaatcataaatgatcatttgaggatgccaaacctgcccacaaacaaaaatattttgccatcatctgccatggatatggctcttcccaagacaaaatctagtgagaagggaaattct

SEQ ID NO: 31972 - DNA, 319 bp, Homo sapiens
tacttgtacttctgtggattttcttctgtgtccctctgccttgtattctctttccctcagtgtctatccatctctgttatatatacacatatgggcatgcatacatatatacatattctatatgtatatatacatgtacattcatttttttcctctgttctttaattttttgtaatatagaattgaaaagtatgttttgcatttcttaattagtatggtttcttgaatatatttttcttgttttcaaaaaatataaaggaggtaagtgaaattatttaaatttctttataattaaaacaacccaaggaattggagtggc

SEQ ID NO: 31973 - DNA, 1043 bp, Homo sapiens
tgggagataatgatagtacctacttcataggttgtgaagattaaatgagataacacagtgcctagaacataattgctttctttcagagcttattatttgtgatcattagataaagggattaattgtaaggagaaataactttaagattatcaggtaactgctgattctggttatattattagccaagatgaagagaaggaaaaaatgggcaggtttggaaagtagccaggaggtaagggaaatgtggaatcacaagttcactttaagtcatatgaaatttgagatgatcaaggaatgaccaactagaaatgttcatgaaatagttaatatatttaaagtgcttagaaaagtgcctggcccagagtaaccaatatatacattacttattgttattattagcaatagcaactgaaaatggaaggctggagctctaaagataaattgagactagaaataatattttccctaatgtctagcctctcaatggcaagtgtggagctggatattatttctcatccatagttttacagcgagaagaaaacagaaaacttggcaatgccaagttcagtaaagatgctgaaagctgtcagaggtggaataacaggaaatgtttccaaaagaaggggcagaattagctatgtccatcttctctaaggtcagaagttgatgacaagatcagaagttggtctgaaaggctatggtagcagtgggttgagccgccgttggtaaaacaatgatgtgaagacaactaaaaaatgacttttgggcagaggaagtagttgtgctgaggatgggtattttgttttgtttttcgaatggttggcacagaagtatgttggtgggcagaggagtagtgaaaagcaaatggttaaagataagaggaggagaaaaaataatcagtctagcaaagttctaggggagatgtggacagatgccttttgaggggaatacggaacatctctgtctttctgaaagagtgtactactctgggccaggcgcggcggctcccgcctgtaatcccagcactttgggaggccaaggcg

SEQ ID NO: 31974 - DNA, 244 bp, Homo sapiens
acctgcttcattcaacagatctgctttcctggggcctcccagtgcacatctgctcctgacaaagcctcttttctcctcctattggtcagactgagagcaaaggcctggcaaggagacatactggttttgctttgtcagcacaattgcctgtgacattataattacaccaaatcttcattattagaaaggccccaatttagagattttcagagcctaaatgggattttctaagtgaaattgatta

SEQ ID NO: 31975 - DNA, 490 bp, Homo sapiens
gtatatctcctaacactatccctcccggctccccccaccccacaacagtccccagagtgtgatgttccccttcctgtgtccatgtgttctcattgttcaattcccacctatgagtgagaatatgcggtgtttggttttttgttcttgcgatagtttactaggaattattttcttaatttagtttttggatcactcattgcaagtatatagcaataaaattggtttttacaatatccatcttgtattatgctatatttccaaactcatttgctagttctaatagtttttaagtgaattccttaggattttctgtatataggaccatgttatttgcaaacatagatagttttacgtcttccttttcaaaccgaatgccttttctttttcttgcctaattgccccggaaactccaatacattggtgaacagcaaggtgagagtggacatatctgtctttttttgtgacctttgtggggaagtattcagtattt

SEQ ID NO: 31976 - DNA, 515 bp, Homo sapiens
ttctgttgaattgagctgatgtgagctgattggcaatgtgagctgatagtttacattgaaagtcattcctctgctcaactgagacaaatgcatatctgattctttcctctgccttattgtttatgtaaaaatgcagattcactgagccagactacattgtgtattcagtgaaaggctgatcaaggactcaaaagaatgcaacatttgtctcttatctacctatgacccggaagcccccaccttcgagttgttccacattctggatggaaccaatgtacatcttacacatattgattgatgtctcatatctccctaaaatgtataaaaccaacctgtgccctgaccaccttggccacatgttgtcagaacctcctaaggctgtgtcacgggcatgtccttaaccttggcaaaggaaactttctaaattgattgagacttgtctcagagatattttgggttcacaagggcaagtgggtgagggactcccacatagactctcatcctttcagtctgtc

SEQ ID NO: 31977 - DNA, 580 bp, Homo sapiens
aacaactaaattcaatatgtgaatttgtttggatcagattcaggcaagccaaccattgaaaacgttcatgagaatgaaggaaggttgattaagggctggcatcacaagttgggtgtcccagaaagcagactctaaaatggacttagtctgcaggatgcttattaagcagtgccctggggaccgatgcttggggaagggaaggaaataggagtgggcagagggagaagtcgagttgggatgtgagcccagcgacagccttagtggaccccacgaggagtcgtggagctggaacagccctgcacagttatcccatgctcagccaagatggccaggcctctccacctggcatggatcagtcattgggtgtaggccaccctggggaaggctgcagtaacacctgatggggttgatactaagggtcttgtcaacagcactcaaagctggtggggtcccaagtcctttgctgaagcttggggtcttgtgcagcccatcaaagcatagatcacagcttgggtattaggcaggcattggttgcatgggccagtgatgtggttatgttagaaaacatacttatttcttt

SEQ ID NO: 31978 - DNA, 639 bp, Homo sapiens
  misc_feature (570)..(570): n is a, c, g, or t
  misc_feature (598)..(599): n is a, c, g, or t
aacaactaaattcaatatgtgaatttgtttggatcagattcaggcaagccaaccattgaaaacgttcatgagaatgaaggaaggttgattaagggctggcatcacaagttgggtgtcccagaaagcagactctaaaatggacttagtctgcaggatgcttattaagcagtgccctggggaccgatgcttggggaagggaaggaaataggagtgggcagagggagaagtcgagttgggatgtgagcccagcgacagccttagtggaccccacgaggagtcgtggagctggaacagccctgcacagttatcccatgctcagccaagatggccaggcctctccacctggcatggatcagtcattgggtgtaggccaccctggggaaggctgcagtaacacctgatggggttgatactaagggtcttgtcaacagcactcaaagctggtggggtcccaagtcctttgctgaagcttggggtcttgtgcagcccatcaaagcatagatcacagcttgggtattttagggcaggcaatttgggtgggaattgggccaagtgattgttgggtttttntttaggaaaccgggattttggggggggnntgacaaggggggggtcccctgggccctttcggggacgggg

SEQ ID NO: 31979 - DNA, 447 bp, Homo sapiens
aacaaagttacagctaataagccaacaaaaagaagaaagctaacaatggaataagaaaaaatattcaattattccaaaaaaaaagcaggaggagagggaagggggaaacaaataactgataggacaaagagaaaacaaataataggatgatagagttaaacctaattacatggataatcgtattaaatgcaaatggtctaaacatcccaaataaaaggcagagattgttagactggcttttaaaacctgacaagactcaactatatgctgccttaagaaaatgcactttgaataaaaaagacatgaagaggttaaaagtaaaaggatagaaagatataccatgctgggaggctgaggcaggagaatggagtgaaccccggggggcggagcatgcagtgagccgaggttgcaccactgcactccagcctaggcgacagcaagactccg

SEQ ID NO: 31980 - DNA, 141 bp, Homo sapiens
gttttggctggatcagcaggtatgggctggattgcaagatgttggaaagtcaagccccggaatctggaaaaaatttaatagtccatatggtgtcattcaaaggtgatggggagggagggaatgaaatggtacagccactta

SEQ ID NO: 31981 - DNA, 370 bp, Homo sapiens
aagacataattaaaatctttacttaaattattaactttattggtaattatttctcattcacttctactttaacactttttttttttgagacaaggtcttgctctgtggcccaggctgggttgcagtgttgtgatcaccagtcagtacagtacagatcctcttgcctcagactcccatgtagcgggtactacaaatgtgtgccaccacatgtggctaattttttcatttttagtagagataaggtctctctctgtttctcaggctggtcttaaacttccaagctcaagtgattttcccacctcggcctcccagaattggccagactggtctcaaactcctgacctcaggcaatccatccactacggcctcc

SEQ ID NO: 31982 - DNA, 646 bp, Homo sapiens
cctatctgtctgtaccctaatccgttaatccatttttttctgatgaatttcaaattaagttgtggacatctgtgtatttcacccctaaatacttgagcatatccctcatttaacttgatttctctcttactttctacaattttatgcaaatgagctgtttcccataggttctgtcttgatcttaatcctttaagggtaagggctaacttgtggttgtgttaatggtcttcatcgctgctgcctatttttttttttaatttccttaaaacaaaaggtactctcaaaaggcatattgcacatgattagcaagattcagaaggaagtggttaaagtttcttacatgccttatacctatgcttttagttcttgttttgtataaggaatgttgcatgaggatattggaaaaaaatttaaaattaagagttgaaggcggaacctgatctataaggatccattatgttgaagccaaagaagcaggtctagctattctaagtaagtaggctggagaggtgtttcttaactctatctgggttttgttttccatttgaagaaaaattattttaagcaattaccatttttgattactgtaatgactcctgtgtccaaaaattaattacgtttctaattattaaaatagaaaaaaaaa

SEQ ID NO: 31983 - DNA, 377 bp, Homo sapiens
agagcagctacttcaccccgttgaagtgcggctgctaaaatgaaatagtgcattggtgtgaaagcactctcagacgtgtacgtggctacttgtatgtataagtgaagtgctgctgagacgttagtgatcaggtcaatttttggcagttgggacgaggggaggcttgcttttgtttgtatagttgagagtggcttgctaaggtgcagaaggtttcctgagcttggctcacacttaggttgctggcacttctttctttgcttcttgtcccattgtgtggcttggagaagcgtgggacttttcattaagttttaatattaataaaatgcaaatttattagaatttgtgctcctcgtgacatatccattatcccactttag

SEQ ID NO: 31984 - DNA, 447 bp, Homo sapiens
caagatggagagctaacaacctctgtcctctagaacatgaattaaacagaaccttaatgtctacagaggagtttgttaaatgaagcccagaaaagctgccaatagagttgcctcttacatattggccttgggatagtgggcatgttgggtctgtaaaccaagtcctcagagccttggtttcctcaactgtaaaatgggttcaagagtccccaccccaggcagatgttttgagaattaaacaggaagttgtgtgttcgaggcacccagcacatcagaattgcctcccacaaataccttcctggggcttcacagccctctaatttgagctcagagatacctcagacaaggacaaagctacaggcacatgggaccccagcctccaacagagaagagagaaatttgaaaccctgaagggacaaaaggtgaatggaagcagaacaggaaact

SEQ ID NO: 31985 - DNA, 653 bp, Homo sapiens
aatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacata

SEQ ID NO: 31986 - DNA, 377 bp, Homo sapiens
ccttggtctccttgaaagtgaatcttgaaaattggattgactattggcagttggtccactgtccagtaagcattgttttgactgaagaaataaatagacagaatgccctcagacaacttatttttgctaatgagcaagttgcttcagtgaacgtagcaaaaatcaggcacgagtcactatatatcacagaaataatctagataaattagaaaattgtccagatactgtaggctgcatttagtaaagccaggcagagcaacaccaagcaggaattatcctcttttgtagttacagataatggatatacaagtacagactgcagttttggtttcacaaatggattttgagtgcaaaggtgcaatttggtaatgaaaagg

SEQ ID NO: 31987 - DNA, 469 bp, Homo sapiens
aaatgtaggcagtatatttaaacaaaacctcgataccattatcacaccttggccagacgcggtggctcatgcctgtaataccagcactttgggaggccaaggggagcggataacttgagatcaggagttcaaggccagcctggccaacatgataaaacctcatctctactaaaaatacaaaaattagctgggcgtgatggcactcacctgtaatcccagctactcaagaggctaaggcaagagagtcgcttgaacctgggaggcggagattgcagtgagccgagatcacactactgtactccagcctagtcgacagagcaagactctatctaaaataacaaaaaccttaatatcacaaaatcagtgttcaaatttccagttgtggcatgaatctcataaatgtgtgggtcttgtgggagagagtggctgttggttttgctttttatagtttatttgatgcattcggtct

SEQ ID NO: 31988 - DNA, 1413 bp, Homo sapiens
accactgcttctttttctgtttttaagcccatggtaacttggggaaggctttgatgctcttactgttatttctactattatgaaaactcaggttttccaaaacaatctcaagttgcggcagtggactgtgagaatagggggccccctcactccccaaacataagaagtatgtgcttttcttcttttatctatcccgctgagatatgtctatcttatttggaataaaagtatttattttggaaaacagctttttagcatttttaaaatgatgacccaactgtcattctcacagccctagatacacctaatggggaaatgtgagccacttaaaagccacttaaaaaccaaagggctttgggaatctatggcttgaggggtgccttcagataacaaaagaaaagtttcaggtatcagttaggatagaggttagacattgtactgaatatatccagcagatcttacatcccattacaaaccccagtaggtgtgttgtatacatacggcttaggggttaagttaacaaagaagtctgataagaaaaggaaatacagaggaagcataaatctctttggaataggattttgttccactcccttagagccctaacagtataccttagaaattattttacgacagtttgtacttaaagaccagaaagctactttagagacttggaaataatgagcctattgtcaaaaggtggtgcttgcggggcattaggactagagggttggtgaaaattcagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttcatacagtcacacacatacacttccttatttcttttatttaaactttgagtaacatagcagtctatgtttgggtcagttttcccttttttgtaattacattcagtggtttttgtaacttcattatttattgggaattagtgatttagtcagtgggagttttgtaaaacttaagattttggcttttttccccctcctcctggataaccagttaacccaataatggcttggccgatggaagggtaaaatgaggacagttatattttttaaatgtcattactgtcaccaaatcacacatatcattttctaagataaggaaatacaaccatttttacaagttgcaaaaaagtactctggcttggcaagtttatagactctcattttcttgataaactaaaaa

SEQ ID NO: 31989 - DNA, 882 bp, Homo sapiens
aaggcatggaataagttttgatcttgggtttactgctaacattgacttttcccgttagcccacctaggttctaaagagctagtatccagagctttgacacatggggtgccaggctttgtttctctgttaaaatcccccaaatttcctgactcctcagaacagctcagctcagctgggagtctgtggctgaggctggccgagacatcagcagagtacctggaatggaactccaagcaggtcgaagcttgggagccagtgtccttgcagtctgaatatttggggtggagagaggtaactctgttatgctcaccgctgggaccacagcaagaattcctttgccaccatttctctagtcaggcggagctgtccagggttcaggtggctttccaggacatgcttcaacttgcctggagatgggtggtgtgagcagatccctgggtgtctctctctggaggtaataatgacaaagaggtttagccactgagggagaaatgcatccccaagtctgaggggatatcccttttcttcaaacaatccctgggttgtttgtctacagtagaactctctttaataaaaaaaaaaaatgaaatgaaataaaaataaagtaaaagaacgcccatcttcagtataccaagcagcatgcagggcataatcgcctcaattcttggtatctggcacaatgttcagttggcagaaccacgctttctgtgggggtaataagcttaatatttagcctgcattactggggcagtggtgaagggagggggacaaaatgggagagagaccactgtagaaatggatattgaattccaagtattattgttggaatctctggagaaaatggctcctgaacatacaggattttcagtacagtttaaaaaa

SEQ ID NO: 31990 - DNA, 324 bp, Homo sapiens
ctctaaatcactaataatgtcaatgttcagcacttgaaaacaataccaaattattacaagccgtataagaagcagtggttgaagagacaagaatgaccacaggcccaacatctttacatctcttaaccctctgtttcctaggttgaaagtgtagaaattatgatctcctgaactgcagcattgtgaagttgacacaaggtgaagcaatgtcacattgtcaccacaacaggatcctttcatgctgagatccaaaaaagccagataacctgagtcaagaatcacaggaaagtcaataacaaaatcaggactgaggtcttgagaact

SEQ ID NO: 31991 - DNA, 165 bp, Homo sapiens
aagtaagtcggtattcaacttcagaatttttgtgaatagaaaaaacagaaatacagaagaaaatgcttagggaactactctctaaaatgaaatgtctctcctaggcagttgcagttaacagtatccaattttctaagcttctctggcagccacttgttacctccc

SEQ ID NO: 31992 - DNA, 884 bp, Homo sapiens
aaaatgggacaatgatacctaactcagaggaggattgtaataatagaataacctttgtaaggcaaaggcttattaaccatggttaaaaacccattaaatagcagttattaaatagcattatcaccaacccagttagcaatgctggggaaaagtcagggaaggaatgtcagaggagagcacatttaagccagttattgaagaatcagcctaagaacacagcacatgactgacaagcctatggcattggattatctgggaaaaggagattggtatatggatgcaacagaactaaatcttatcttaaaaacaacatgaatcacaaaagcatttatgctgaatgaaagacgccagatacagaagagtacattgtgtatgattacatttatatgaaaccctaaaacaggcaaaatagatttatactgatagaaagagcatggtagttgcctaaggcagtttgcagggggtgacacagagcaagaggactctttgtggagtgacagaccagcttcacatcttgatcatggtggtggttacatgggtgtatgcatttgtcaaaactcagcctgtgcaagtaaatgggcacattgtattgtatgaaaattatactaaaaacccagaatcctctcacctctatcccttgacaacccctaccaatggcagttacattttcacttctgccctctctaccagcaaattgatagctccaagctacacagttcccagcacatcattacagcttgttaacttggagtcacccagacaaatttctctccctcccattcaattttgaattaagtcagaaaaagacagattagcaaaacattaccagagatagaatttatgacaagcagctaatttttccaggactttcactaacatctccc

SEQ ID NO: 31993 - DNA, 562 bp, Homo sapiens
aatatttaactcttgaaaatgttaaactctttggttgcagaatgattactccattataaaggatagatcttttttagagtagaaaataggaaatgataggaacaaagttggcatgtcaacataatgaacaaatttaacatctgcatattcctaaagtacttttctaaattacttgtttcttgagattagtcaacattaagaaaaaaattgttttacaacaataattttgccccattgttttttaaattagattgtgtatagttacctaaattgtggtttcattttactcaccagaccatattaagctgtggaaccattagaaattggtgacagacaacactgataagtgggcattggcagcactaatagttatttgttgctgactatgcaacaaaaaagctaaaagctataaaacataatgcctgaatttttcatttgttctatagtagctatctaaaaaaatccaagtttgcttatgtaatattatttggtgtggtcatttgcccaaaatgaaataagctgtaagtttgtataatataaaataatctacctaaatcgtaca

SEQ ID NO: 31994 - DNA, 405 bp, Homo sapiens
ctctgtcctaaatctgacctgacaggctcttattaatgactgccacaacagaaacactgagaaaaagaggcaaccatgaaaacgtggaaagttctgacgacagaaaatagcaatcagcctttctcacatcccaaagctttaaaaaatatatgagtgcagcatggccagtatggaattgaccaaaaactaatcatcaagctagaaacgtggtgagagaaaaaaaaagggcaagaatatctttggcttatcacctcccacttttgcctactaatctgatgctgaaaagaaatgctcactgaagcattttagattttgaatctttcagatttgggatgctaaaccagtaagcatatgacaaatatttcagaataaaaaaatgtcagaaatccaaaacactttttgttc

SEQ ID NO: 31995 - DNA, 659 bp, Homo sapiens
ccagtactttgagctgctgttttacaatgaacatttttcattccttatcctagtggacccctatgacgttattgccattggctgtccttcccctactagtgttttcttttggctcccgtgtcagttctccgagattttaaacctccgcgactgttctctcttggtgggttcttctccttttattctcccctgtaaaatgctgtcattctcattccactcaatgagtctgggtctctaacccaggtccattctccacatttcacaccaagtagccatttagaatccctatctggataacctacaggaatctcaattcaccatgtctaaaactgaaatcccgccccttcctcctggattcacaacctcaactggtggtaccacaatctaccttatcacccatgccaggaacctaagatcactgttcctacccattccccaactgatcaataatcgggtcctgctaacttaatgcctaaacattttgggcactccctcctcttcatccttacaactactgcctttcatcgtcttttccatgaactatcatgatgaaatttctaacatgcaaatttgtttacgcatttcttcatctatttaaaattcttcagtggctctccagggtctttagagcctgcttctcaccatgttttcaagatctt

SEQ ID NO: 31996 - DNA, 310 bp, Homo sapiens
tcccaaggtgtttttcccattcctgagagctctgcagagatcttatttgcgtgaagcaaatccataaagtcattagcagataagtagatggacctgcctgtggtgaacacccaggctttcaacctaatagtttgttggcctggctggtggttcctgctgaaaatctttggggataattagcacagctgactgttgctgagccaggtaaaaacaccttgggaatgtcaagtttcacagatcagagccaggtttaatgccactaaagagcttcagaatttgagctcatgagttggtcgcccttttccgtcga

SEQ ID NO: 31997 - DNA, 318 bp, Homo sapiens
gtccaacaaaaaggtccttataaaaagaagagaagacacacacaatgaaggccatgtgaaggtggaggtagaggctgcagtgatgttgaatgcctggtgccaccacaagctgaaagagccaaggatggattctctaaaaccttccaagggagcacggccctgctgacgccttgactttcgatttctggcctccagaactatggaagaataaatttgtgttgcttgaaaacaccaagtttgtggtaatttgttatggcagccctatgagactaatagagtaagtatcctcaggacgatgaaaataaatgccagcgccta

SEQ ID NO: 31998 - DNA, 264 bp, Homo sapiens
acttgtgggaaagtaatgtagaatattactttaaaagagactaagctataaatttgaatacatataaaaaagcagtacccaagagtaaatatgtttgagcccaaaattacaaaatatccagttacaaatagattctaataaagattttactcaaaacaaaaatctacccactaatgcattaaatataagtgcattttaattaagactttaatttttttaaagcataactggtcataagaataatcctctgaaatgcatcttttc

SEQ ID NO: 31999 - DNA, 524 bp, Homo sapiens
agttataattttggtaagtggttctcctttgcccacaccttaccaggacaaaaggagcttactctacccaggcaattaagcaatctcccaccaccaccaagctcaaatgttttcatcatagactagggttcatttttatttccttccctggagctttgtaattctttcagcgtaaacattgttgaggttcaacagtccttattgctgagtaggactcgattgtatgaatatactataatttgttaatctgttttcctgttagtgaacattttattggtttctagtttttggcaagtgtgagtaaagctgctatgaacatttgcacacaaatattgtgacttctgggcatgtagtggtatcttgtggtttcagtctgcatttctctgactaatgaacacgttctcgtgtttattggccattaatatgtctttgagtgtgtatttttaaattaggttcgtttttattaccaagttataggaactctatgtattttgaataaaattccttgtcagttattttgcaaa

SEQ ID NO: 32000 - DNA, 857 bp, Homo sapiens
agttataattttggtaagtggttctcctttgcccacaccttaccaggacaaaaggagcttactctacccaggcaattaagcaatctcccaccaccaccaagctcaaatgttttcatcatagactagggttcatttttatttccttccctggagctttgtaattctttcagcgtaaacattgttgaggttcaacagtccttattgctgagtaggactcgattgtatgaatatactataatttgttaatctgttttcctgttagtgaacattttattggtttctagtttttggcaagtgtgagtaaagctgctatgaacatttgcacacaaatattgtgacttctgggcatgtagtggtatcttgtggtttcagtctgcatttctctgactaatgaacacgttctcgtgtttattggccattaatatgtctttgagtgtgtatttttaaattaggttcgtttttattaccaagttataggaactctatgtattttgaataaaattccttgtcagttattttgcaaatattttccccattgtgtgtcttgactcttgattttttttatagtgttttgagcagaagtttccactggagtcttaatttatcaatttttaaatggactttttctaaataaatctgcctacctccaaaaaaaaaaacaaaaaaacaaaagaaaaaaaagcaaaaacaaaaacagaaaagaaaacaaaaaacacagcacagaaaaaaaaagcagaaaaagaagaaaaacaaaaagagagggggggcgggctctagagaggattctccccttgggggggggcaccattctggtggggcgagcaaccttgttttttggttcgcagggggggccccag

SEQ ID NO: 32001 - DNA, 162 bp, Homo sapiens
cttgattttttttatagtgttttgagcagaagtttccactggagtcttaatttatcaatttttaaatggactttttctaaataaatctgcctacctccagattgttatggtggtattgttttctcataaaatgtttaagcttttatgtttttaggtctatta

SEQ ID NO: 32002 - DNA, 428 bp, Homo sapiens
gaactactcctgccccttttaaagggaagggagtgttatcgagccgaactggggtctacttgccctgtgtagtaaggtcaaatatctgtatcgaggcttgtagtggtagaaagcagggtgtttatttgtagggtgccaagcaaggagaatcaggcagcttatgcttaagatctgaggcatataggtaagggtttttaaggcagggaggcaggggttataggcagtcatgaattaattttttgagctttccctattaatatttatgtgaatgagcctggacaacatggtgaaaccccacctctaaaaaatacaaaaattaaatacaaaaaattagccaggcatggtggcaggcgcctgtagtcccagctacgtgggaggctgaggcaggagaatggcgtgaacccgggacacggagcttgcagtgacct

SEQ ID NO: 32003 - DNA, 399 bp, Homo sapiens
tttttttttttgagacaaggtctgtctctgtcacccaggttttagtgcagtggcctgatctcggttcactgcaacctctgcctcctgggttcaagagattcttgtgcctcagcctttggagtaggtggaactacaggcgtgaactaccactcccagctaatttttgtatttttggtagagaaggagtttcgccacgtggccaggctagtcttgaactcctggcctcaagggatacacccacctcggtctcccaaagtgctgggattacaggtgagagccacggtgctaggcctatattcacccaaactcttacagtcccccaaaatttgactgtacaccaacacctattctttcaaatattgaataggaagcccctcaaatgagatggaattaatactc

SEQ ID NO: 32004 - DNA, 1109 bp, Homo sapiens
tgccacttgcctggccctgtacccagggcctatctgggagccattcctgctatagctgggaccacttgtgaaacggctagttgtgcctaacagacatgctcagattcacaaaatgaattcagaacacttacctgtcccacccgtgaaagtgaccttggaggtgtcattgccccccaccaccccagtttctagtccaagccaacagctggtgctagatagatgcttgatgaatgagcagatttgactgttagttactctgtacctaaaactcctatctttacatcaaagccctgacagatttgcccttgacagactgaaatccggggctgctgcagggttcacctccaggaggcaccattcacgacactgtcccataaatggtaatgggctcccagggatactgtttacatagactgcactgagaacggtgacccttaggtttgtacaatgaggtaccctgttgaatgaccctaaaccagcctccaaaatgtgcaggatcccacattggtcagcgccaaccctgagcacaggatctaaaactatagatgatatggccaccctggccacagctggaaccaagctggtggcccaagagagagcctcttcttggaattgcatgtcagtttctcatacgcagtttcttcctatttttcccatttcccgttttaaagctagtggcatacctcacagtcaaataaccaagtggtcagtgtctcgacaatgtgcagtaacgaggtgggggctgcaagggtgaggggctcagtcaccttaacaaggcaggagacctcccacaaaaggctgatgtgtcgtccccagggccagctggacaagggcatgcagcgcaggggtagggggatggaaatattttctctcccgtaaactctgacttcatgtgagcaggcatggggtctccctgagagctgataaccgggaaaaccaaaaccaataatattcctaataataatactagaatgtaagaataatcatgtgtttttcactgaccgctgttgctctgcttttgtctttatatacagtagtttttataacaatgtccctaggttttaataaaggagtgtcatgtcaactgttccctagattgacgtttgctt

SEQ ID NO: 32005 - DNA, 558 bp, Homo sapiens
ctattttttgtatttttagtagagacagggtttctccatgttggtcaggctggtcttgaactcttgacctcaggtgatccacctgccttggcctcctgaagtgttgggattacagctgtgagccaccacgcccggccaaaaatccattttaaaagcccaatttttcacttctatttggttcagtgtttttcacctcttaaatggagttaataacaataacacctgttacatctatctctgatggttgttgtgagatgagatatgtgatgaagggctggatgcagtggctcacgtctgtaatcccaacaatttgggaggctgaggtgggaggatcacttgagcccaggagttcgagaccatcctgggcaacacagacccccatctctactaaaaattaaaaaaaaaaaaattagcccttcatggtagcacacacttgtagtctcagctattagggaggttgaggcaggaggatcacttgagtgtggaaggttgaggctgtagtgagccatgattgcaccactgcactccagcctgggcaacagagagacatcctttctc

SEQ ID NO: 32006 - DNA, 133 bp, Homo sapiens
gcatagacttggggctagacaggttgaaatcatggctagccatctaacaagctttgtaactttataaattgtttattttatctgagagttgatttcttcatttataaaatgaagatggtatctgctgaatata

SEQ ID NO: 32007 - DNA, 267 bp, Homo sapiens
tttttagtagagatggggtttcaccatgttagccaggatggtctcgatctcctgacctcgtgatctgcccgcctcggcctcccaaagtgctgggattacaggcatgagccaccgcgcccggcaaaaaaaaatttttaaagaaaatttttaacgtttgtttcaataaaaattaaaacaatgagatacaatttctcatctaattggcaaagtttttgacaattggtaatagtgaggctgtactgatagagtcactttcaaacactgtta

SEQ ID NO: 32008 - DNA, 431 bp, Homo sapiens
agaagctatgtctaccttctctgcttaacataatgctttcaaggctcatctgtttcgcagactttatcaatgcttcactcctttttatgagtgagtattacattgcatggatataccactctttcgtcacccatttatcagttgacagacatttggattgtccactctttgactattaggaatagtgctattactacatttgtgtacacattttcatgctgatgttttcaactgaattctcttaggcacatttatttttaaatgctagtctgacttcttcccttagttacagaatagcaacatgttattcaaatataagtaaatactaagctttaatttggaagcctatgcatgcttgagagaaatcacaattgcttacactatgacaacactagtgaaaacaaagtcttgatatggctatgtgactggac

SEQ ID NO: 32009 - DNA, 357 bp, Homo sapiens
ttctcctgcctcagcctcctgagtagctgggattacaggcgcacaccaccatgcctggctaatttttgttgttttagtagagacggagtttcaccatattggtcaggctggtctcaaactcttgacctcatgatctgcctgccttggcgtcccaaagtgttgggattacaggcgtgagtcactgtgccctgccagtattgttttgtctaaattatttgtgctgatgtttttcctactgtggttttcttcagattacccttgctctgagcctgcaattgactcatgaacttcttttccatgttctaaccttacaatgacttccttgtgttcactccaaatgtttttccctggttgcat

SEQ ID NO: 32010 - DNA, 1207 bp, Homo sapiens
  misc_feature (5)..(5): n is a, c, g, or t
  misc_feature (711)..(711): n is a, c, g, or t
ggccnacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtctttccagttgtcataggaaaccagatgctnaacctgagaacttttacacagatagaaccaaccacagagactggttccaggaaacctctgacggggtactgaaaagaaagcaaactaaagactgcccccagagaaaatggtatccattgcggccaaagaaaattaatcttgatacatgagctctttctgtttatttgggagttgaaaataggcaccatcaacatttagattacagcctaattaatacctagataagacttcatttgaaataagaaataactcttttactagtgattcatttatacagatatagtatctctgtgcggggatatgatataatatgtatttccttactgttttatctattgtaaataaaaagcattttacaaagtatcgacacagagcccatcagtgggcataaaaaatattacaagtgcaagacttttactgtccttaagtgccatcaactctcagctccttgtagctttgtggggatttaacaagtaacaaattctgtgtgttcctg

SEQ ID NO: 32011 - DNA, 1141 bp, Homo sapiens
  misc_feature (5)..(5): n is a, c, g, or t
  misc_feature (645)..(645): n is a, c, g, or t
ggccnacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagagtccttgcctgcattaattgaacaaggagagggattttcccaagttctcaggatgcagcctgttatccacctccagaggattcaccaagaagtctttccagttgtcataggaaaccagatgctnaacctgagaacttttacacagatagaaccaaccacagagactggttccaggaaacctctgacggggtactgaaaagaaagcaaactaaagactgcccccagagaaaatggtatccattgcggccaaagaaaattaatcttgatacatgagctctttctgtttatttgggagttgaaaataggcaccatcaacatttagattacagcctaattaatacctagataagacttcatttgaaataagaaataactcttttactagtgattcatttatacagatatagtatctctgtgcggggatatgatataatatgtatttccttactgttttatctattgtaaataaaaagcattttacaaagtatcgacacagagcccatcagtgggcataaaaaatattacaagtgcaagacttttactgtccttaagtgccatcaactctcagctccttgtagctttgtggggatttaacaagtaacaaattctgtgtgttcctg

SEQ ID NO: 32012 - DNA, 1086 bp, Homo sapiens
  misc_feature (5)..(5): n is a, c, g, or t
  misc_feature (590)..(590): n is a, c, g, or t
ggccnacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgagtccttgcctgcattaattgaacaaggagagggattttcccaagttctcaggatgcagcctgttatccacctccagaggattcaccaagaagtctttccagttgtcataggaaaccagatgctnaacctgagaacttttacacagatagaaccaaccacagagactggttccaggaaacctctgacggggtactgaaaagaaagcaaactaaagactgcccccagagaaaatggtatccattgcggccaaagaaaattaatcttgatacatgagctctttctgtttatttgggagttgaaaataggcaccatcaacatttagattacagcctaattaatacctagataagacttcatttgaaataagaaataactcttttactagtgattcatttatacagatatagtatctctgtgcggggatatgatataatatgtatttccttactgttttatctattgtaaataaaaagcattttacaaagtatcgacacagagcccatcagtgggcataaaaaatattacaagtgcaagacttttactgtccttaagtgccatcaactctcagctccttgtagctttgtggggatttaacaagtaacaaattctgtgtgttcctg

SEQ ID NO: 32013 - DNA, 1152 bp, Homo sapiens
  misc_feature (5)..(5): n is a, c, g, or t
  misc_feature (656)..(656): n is a, c, g, or t
ggccnacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtctttccagttgtcataggaaaccagatgctnaacctgagaacttttacacagatagaaccaaccacagagactggttccaggaaacctctgacggggtactgaaaagaaagcaaactaaagactgcccccagagaaaatggtatccattgcggccaaagaaaattaatcttgatacatgagctctttctgtttatttgggagttgaaaataggcaccatcaacatttagattacagcctaattaatacctagataagacttcatttgaaataagaaataactcttttactagtgattcatttatacagatatagtatctctgtgcggggatatgatataatatgtatttccttactgttttatctattgtaaataaaaagcattttacaaagtatcgacacagagcccatcagtgggcataaaaaatattacaagtgcaagacttttactgtccttaagtgccatcaactctcagctccttgtagctttgtggggatttaacaagtaacaaattctgtgtgttcctg

SEQ ID NO: 32014 - DNA, 868 bp, Homo sapiens
  misc_feature (5)..(5): n is a, c, g, or t
ggccnacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatataacacagatagaaccaaccacagagactggttccaggaaacctctgacggggtactgaaaagaaagcaaactaaagactgcccccagagaaaatggtatccattgcggccaaagaaaattaatcttgatacatgagctctttctgtttatttgggagttgaaaataggcaccatcaacatttagattacagcctaattaatacctagataagacttcatttgaaataagaaataactcttttactagtgattcatttatacagatatagtatctctgtgcggggatatgatataatatgtatttccttactgttttatctattgtaaataaaaagcattttacaaagtatcgacacagagcccatcagtgggcataaaaaatattacaagtgcaagacttttactgtccttaagtgccatcaactctcagctccttgtagctttgtggggatttaacaagtaacaaattctgtgtgttcctg

SEQ ID NO: 32015 - DNA, 1262 bp, Homo sapiens
  misc_feature (5)..(5): n is a, c, g, or t
  misc_feature (766)..(766): n is a, c, g, or t
ggccnacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagtggatgtacaacagggtggtacatccactggacctaaaatatgaccctgatccagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtctttccagttgtcataggaaaccagatgctnaacctgagaacttttacacagatagaaccaaccacagagactggttccaggaaacctctgacggggtactgaaaagaaagcaaactaaagactgcccccagagaaaatggtatccattgcggccaaagaaaattaatcttgatacatgagctctttctgtttatttgggagttgaaaataggcaccatcaacatttagattacagcctaattaatacctagataagacttcatttgaaataagaaataactcttttactagtgattcatttatacagatatagtatctctgtgcggggatatgatataatatgtatttccttactgttttatctattgtaaataaaaagcattttacaaagtatcgacacagagcccatcagtgggcataaaaaatattacaagtgcaagacttttactgtccttaagtgccatcaactctcagctccttgtagctttgtggggatttaacaagtaacaaattctgtgtgttcctg

SEQ ID NO: 32016 - DNA, 2132 bp, Homo sapiens
gcagcctgaggcagagctcgggggctgtcggtggggaccttgcaggagggcaccccaagcccgcccggcccgcccaacccagcccctgcgcgcagcccgggccgagtaggaccccgcgcgcccctcgccatggcggcgccctcgcggctcctgatccgcgggggtcgcgtggtcaacgatgacttctcggaggtggccgacgtgctggtggaggacggcgtggtgcgggcactcgggcacgacctgctgcctcccgggggcgctcctgcggggctgcgggtcctcgacgccgccggcaagctcgtcctgcccggaggcatcgacacacacacgcacatgcagttccccttcatgggctcgcggtccatcgacgacttccaccagggcaccaaggctgctctctcaggaggcaccaccatgattattgatttcgccattcctcagaaaggtggctccctcattgaggccttcgagacctggcgaagctgggctgatcccaaagtttgctgcgactacagccttcatgtggcagtgacgtggtggagtgaccaggttaaagaagaaatgaaaatccttgtgcaagataaaggtgttaactctttcaagatgtttatggcctataaagatctgtacatggtgacagacctggagctgtacgaagccttctctcggtgcaaggaaattggagcaattgcccaggtccatgcggaaaatggagacttaattgcagagggagcaaagaagatgttggctctggggataacaggccctgagggccacgagctgtgccgcccagaggcagtggaggcagaggccacgctgagagccatcaccatagccagcgctgtgaactgtcctctctacattgtgcatgtgatgagcaagtctgcagctaaggtgatagcggatgcaaggagagatgggaaggtggtctatggtgaacccatagcagccagtcttggcacagatggcactcactactggaataaagaatggcaccatgcagcccaccatgtcatgggtccacctttgcgaccagacccctcaacacccgacttcctcatgaatctgttggctaatgatgatctaaccacaacagggactgataactgcactttcaacacctgccagaaagctcttgggaaggatgattttaccaagatccccaatggggtgaatggtgttgaagatcggatgtccgtaatatgggaaaaaggcgtgcatagtggtaaaatggatgaaaacagatttgtggcagttaccagcacaaatgcagccaaaatttttaatctctatccaagaaaaggaagaatagctgtaggatcagatgctgacattgttatttgggacccaaaaggcacaaggactatctcagcaaaaactcatcatcaggctgttaacttcaacattttcgagggcatggtttgccacggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccggacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32017 - DNA, 4165 bp, Homo sapiens
gatgcagcacaacaaaagagcctgacagaaacggagtcagcccacgccaggccaaaccacaaaaagaagaaagcaggcttagatgggaagcccccttcatagctccctccccaaaaatcccttctacccatatctattgagtgcttgttatgaagaaagagagcagcacaccggccctctgtctgctgggggagactgacgagtgaacagattattccagaaacctggggtaagcaagatagtggataggggacagagggccaaagcttcctagactgatgattagctgagctgagtgataaaagagaagtcagataattacacaaaaatgagagcggcagcccagcccatgcaaaagcatggccctgaccggaagctaccaggaaggattctgatgtgcctggcctgggtggtgcctgctcccagagcctgcaagctgggttctggggaagcatcctctaggtgatagagcaggctgtagagcaagccctgttctgagtgaggaggacaggccctgtgtgtgatggccccacctgagccactggcatgggcagtcagttcccaagacggagtccaggacagacaaaaaatgaacagctgaaaagtgcaagtagtgtaggttcaaggaagtggtgtaggaagagggagacggaatgggatctgaggagggctgcacagcacacagtaggcggcacaaaagtctgctcagttaggtcacatgctccagaggcactcactgcaaaagagcctgaagattgaactgaaatataccatcggctttgctgagtatgaatgccaagaggagcagagagaagtcaagccctctaggtgataggcaggaacgagctgaaagaaggacataaatcttggtttgctcagacgggcctggattatacttacgttaattatgtttagtgcccttttcatgctaagaagtgtcctactttggatgataaattgtacagtcaccctaggtttaagtgatattcaggcagtctggcttggaaagtcaagtcaggagaagaaaaaaaaaaaaaaaaaaacagggaccaaggacctgaaagggaggatgtggccagagagtggggtattagtgagtttaaggtttcagatgtggtggtccaaggtggtagaaatgggaggctggcccttcatttcctggtgtctgtgttcctcaagatgagaacagggctcaaagactgagtagacagtgagccaaaatggaagtccagcaaagcatttagacagatacagaaagtgagcagaggcttggcctggtgagggaagggcaggagtccccccatttcctgagcactcagtgcacacccgatgcagtgcttcaaattctgtggctgcaggagctgtgggccttgttctgtgttggatactcggtgtttggtgtactctctggggctgtgtgagctcagtaaatatctgctgaatgaatgaagaaaatgctttggctctggaaattctccactatctgagagataggtttatttcccccatttcatggatgaggaagtaggcctggaggcattaattaacttgtcagtttcctatgtgtagtaaatggcaaatggagaattctaacttagatctgtctcacttcaaaggtcacactgttgatcactacaatgtattagtttgggtggtcaaaatgagacccacaataatttgttatttgtctgtgtgtgtgtgtgtgtgtgtgtgtgtgtgtgtgtgtgatttcaaaactctgctcaagcactgacagctctcgctgaatccagcagagggttctgctgcatagtcggtcaccaacgaggtgagattctgtggaagatccataatgcacagagacaggaaagtggaaagcgtacccaattgctagaatctgaagcaactgctctgagagtgttaggagaggtacaaagaagcactgcaaactcaggtgagtaggactgaaactagaagaaaaggtcggatgttggaaaggacagcaggagacacttgtgggactcagaagggcgtgaggatatggcagaggccccagtgagtgtccctgggcctctgtctgaggcagattaatacccacaaaaagtgggacaatccagattctcaaggttgccaggaatttctgtgaaaggccaaggggatggggaggcacgtgataaatttataagattctttttttaaagctctcgcaattcataaagggagctacacttaactttgaactcaagaaaataaaccacaagagagaaatgaaatgttctctttcagacttgcacacctacccctgtggagcgtgcaccctataagggagaagtcgccacactgaaatccagagtgacaaaagaagatgccacagcagggaccaggaaacaggcccacccctgaagtgtgtgccatcggtaagggactgtaggcaagaaaagtcttcctgcatgacagcatatgaaattagcatctctcctcataagggttgaagagatcaaggtcagaggcttcacagtgatccaagactcaaggacaattgagccaagggaagattgatcaaagcagaacatttagataagccttccagattgtagaaggccttgggcttgctagagagtcattctttaagatgttaggaaacattcaatacagccttggataatcaactatgagcaagttgcactaaggaggctgataacatacagagggaactacttaagacagggagtataatttcatggtcaaaatttacaaatgaattaggaccttatctggagaaatgaatcttcatattgtaaatacaacggtgttctaaaatttagaataaatgaaaaatgaataaaatgttgctttaggggatataatccttcagaaaaattctttgatagtatctgattatttcacagttagttttgggaataatattacagatacagtcatttttgcaaaagtatttgagcacttcatcagttttctctgtcttttgacatgcagatctttcttttctgaagtgcctcgtatcatcatccttgtcaattttctttcttcagttgtcttctggtcctgctctctcagatcctcatttaacagcggctttgctgtaattttagcatctccctaatatcacttccactgacttcatgaaatctacatgttttgccagttttgcaattttgctaggctcttaatttttttttaacgtgtgatatcttttcagacagttcaacacgtggccatctgcacaagacttaaccccagaggttgacctaatggacctggttagacatttgtgttaatgagaggcacagtttgacaacggtctggttttctacatattcaggcactgcaccttttcacattttgacaacctcttattccctgcataaatcctgttcctgcagggatttggataatgagggcttgaatggcaaagccctctgtgctacatgccatgttctttcattattgaatgttgtgtctttaacaggactatctagcccaaagtctcaacatttttgtcattttcagacgaccagaattattcttctaatctaggatgattttgttaaaaattcagggaaagattagcaagagaaaggaatgcgattcaatgctataacatgctattaatgacatttataggagcaggattagtgtttactttgattatagcatttcttgggggttaggtttgaattctgcatctctttgtgagggagaatgttacagtgagttcctttcattctcttcaaaggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32018 - DNA, 2078 bp, Homo sapiens
gcagcctgaggcagagctcgggggctgtcggtggggaccttgcaggagggcaccccaagcccgcccggcccgcccaacccagcccctgcgcgcagcccgggccgagtaggaccccgcgcgcccctcgccatggcggcgccctcgcggctcctgatccgcgggggtcgcgtggtcaacgatgacttctcggaggtggccgacgtgctggtggaggacggcgtggtgcgggcactcgggcacgacctgctgcctcccgggggcgctcctgcggggctgcgggtcctcgacgccgccggcaagctcgtcctgcccggaggcatcgacacacacacgcacatgcagttccccttcatgggctcgcggtccatcgacgacttccaccagggcaccaaggctgctctctcaggaggcaccaccatgattattgatttcgccattcctcagaaaggtggctccctcattgaggccttcgagacctggcgaagctgggctgatcccaaagtttgctgcgactacagccttcatgtggcagtgacgtggtggagtgaccaggttaaagaagaaatgaaaatccttgtgcaagataaaggtgttaactctttcaagatgtttatggcctataaagatctgtacatggtgacagacctggagctgtacgaagccttctctcggtgcaaggaaattggagcaattgcccaggtccatgcggaaggccctgagggccacgagctgtgccgcccagaggcagtggaggcagaggccacgctgagagccatcaccatagccagcgctgtgaactgtcctctctacattgtgcatgtgatgagcaagtctgcagctaaggtgatagcggatgcaaggagagatgggaaggtggtctatggtgaacccatagcagccagtcttggcacagatggcactcactactggaataaagaatggcaccatgcagcccaccatgtcatgggtccacctttgcgaccagacccctcaacacccgacttcctcatgaatctgttggctaatgatgatctaaccacaacagggactgataactgcactttcaacacctgccagaaagctcttgggaaggatgattttaccaagatccccaatggggtgaatggtgttgaagatcggatgtccgtaatatgggaaaaaggcgtgcatagtggtaaaatggatgaaaacagatttgtggcagttaccagcacaaatgcagccaaaatttttaatctctatccaagaaaaggaagaatagctgtaggatcagatgctgacattgttatttgggacccaaaaggcacaaggactatctcagcaaaaactcatcatcaggctgttaacttcaacattttcgagggcatggtttgccacggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccggacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32019 - DNA, 2011 bp, Homo sapiens
gcagcctgaggcagagctcgggggctgtcggtggggaccttgcaggagggcaccccaagcccgcccggcccgcccaacccagcccctgcgcgcagcccgggccgagtaggaccccgcgcgcccctcgccatggcggcgccctcgcggctcctgatccgcgggggtcgcgtggtcaacgatgacttctcggaggtggccgacgtgctggtggaggacggcgtggtgcgggcactcgggcacgacctgctgcctcccgggggcgctcctgcggggctgcgggtcctcgacgccgccggcaagctcgtcctgcccggaggcatcgacacacacacgcacatgcagttccccttcatgggctcgcggtccatcgacgacttccaccagggcaccaaggctgctctctcaggaggcaccaccatgattattgatttcgccattcctcagaaaggtggctccctcattgaggccttcgagacctggcgaagctgggctgatcccaaagtttgctgcgactacagccttcatgtggcagtgacgtggtggagtgaccagataaagatctgtacatggtgacagacctggagctgtacgaagccttctctcggtgcaaggaaattggagcaattgcccaggtccatgcggaaggccctgagggccacgagctgtgccgcccagaggcagtggaggcagaggccacgctgagagccatcaccatagccagcgctgtgaactgtcctctctacattgtgcatgtgatgagcaagtctgcagctaaggtgatagcggatgcaaggagagatgggaaggtggtctatggtgaacccatagcagccagtcttggcacagatggcactcactactggaataaagaatggcaccatgcagcccaccatgtcatgggtccacctttgcgaccagacccctcaacacccgacttcctcatgaatctgttggctaatgatgatctaaccacaacagggactgataactgcactttcaacacctgccagaaagctcttgggaaggatgattttaccaagatccccaatggggtgaatggtgttgaagatcggatgtccgtaatatgggaaaaaggcgtgcatagtggtaaaatggatgaaaacagatttgtggcagttaccagcacaaatgcagccaaaatttttaatctctatccaagaaaaggaagaatagctgtaggatcagatgctgacattgttatttgggacccaaaaggcacaaggactatctcagcaaaaactcatcatcaggctgttaacttcaacattttcgagggcatggtttgccacggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccggacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32020 - DNA, 2825 bp, Homo sapiens
gatgcagcacaacaaaagagcctgacagaaacggagtcagcccacgccaggccaaaccacaaaaagaagaaagcaggcttagatgggaagcccccttcatagctccctccccaaaaatcccttctacccatatctattgagtgcttgttatgaagaaagagagcagcacaccggccctctgtctgctgggggagactgacgagtgaacagattattccagaaacctggggtaagcaagatagtggataggggacagagggccaaagcttcctagactgatgattagctgagctgagtgataaaagagaagtcagataattacacaaaaatgagagcggcagcccagcccatgcaaaagcatggccctgaccggaagctaccaggaaggattctgatgtgcctggcctgggtggtgcctgctcccagagcctgcaagctgggttctggggaagcatcctctaggtgatagagcaggctgtagagcaagccctgttctgagtgaggaggacaggccctgtgtgtgatggccccacctgagccactggcatgggcagtcagttcccaagacggagtccaggacagacaaaaaatgaacagctgaaaagtgcaagtagtgtaggttcaaggaagtggtgtaggaagagggagacggaatgggatctgaggagggctgcacagcacacagtaggcggcacaaaagtctgctcagttaggtcacatgctccagaggcactcactgcaaaagagcctgaagattgaactgaaatataccatcggctttgctgagtatgaatgccaagaggagcagagagaagtcaagccctctaggtgataggcaggaacgagctgaaagaaggacataaatcttggtttgctcagacgggcctggattatacttacgttaattatgtttagtgcccttttcatgctaagaagtgtcctactttggatgataaattgtacagtcaccctaggtttaagtgatattcaggcagtctggcttggaaagtcaagtcaggagaagaaaaaaaaaaaaaaaaaaacagggaccaaggacctgaaagggaggatgtggccagagagtggggtattagtgagtttaaggtttcagatgtggtggtccaaggtggtagaaatgggaggctggcccttcatttcctggtgtctgtgttcctcaagatgagaacagggctcaaagactgagtagacagtgagccaaaatggaagtccagcaaagcatttagacagatacagaaagtgagcagaggcttggcctggtgagggaagggcaggagtccccccatttcctgagcactcagtgcacacccgatgcagtgcttcaaattctgtggctgcaggagctgtgggccttgttctgtgttggatactcggtgtttggtgtactctctggggctgtgtgagctcagtaaatatctgctgaatgaatgaagaaaatgctttggctctggaaattctccactatctgagagataggtttatttcccccatttcatggatgaggaagtaggcctggaggcattaattaacttgtcagtttcctatgtgtagtaaatggcaaatggagaattctaacttagatctgtctcacttcaaaggtcacactgttgatcactacaatgtattagtttgggtggtcaaaatgagacccacaataatttgttatttgtctgtgtgtgtgtgtgtgtgtgtgtgtgtgtgtgtgtgtgatttcaaaactctgctcaagcactgacagctctcgctgaatccagcagagggttctgctgcatagtcggtcaccaacgaggtgagattctgtggaagatccataatgcacagagacaggaaagtggaaagcgtacccaattgctagaatctgaagcaactgctctgagagtgttaggagaggtacaaagaagcactgcaaactcaggtgagtaggactgaaactagaagaaaaggtcggatgttggaaaggacagcaggagacacttgtgggactcagaagggcgtgaggatatggcagaggccccagtgagtgtccctgggcctctgtctgaggcagattaatacccacaaaaagtgggacaatccagattctcaaggttgccaggaatttctgtgaaaggccaaggggatggggaggcacgtgataaatttataagattctttttttaaagctctcgcaattcataaagggagctacacttaactttgaactcaagaaaataaaccacaagagagaaatgaaatgttctctttcagacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32021 - DNA, 2771 bp, Homo sapiens
gatgcagcacaacaaaagagcctgacagaaacggagtcagcccacgccaggccaaaccacaaaaagaagaaagcaggcttagatgggaagcccccttcatagctccctccccaaaaatcccttctacccatatctattgagtgcttgttatgaagaaagagagcagcacaccggccctctgtctgctgggggagactgacgagtgaacagattattccagaaacctggggtaagcaagatagtggataggggacagagggccaaagcttcctagactgatgattagctgagctgagtgataaaagagaagtcagataattacacaaaaatgagagcggcagcccagcccatgcaaaagcatggccctgaccggaagctaccaggaaggattctgatgtgcctggcctgggtggtgcctgctcccagagcctgcaagctgggttctggggaagcatcctctaggtgatagagcaggctgtagagcaagccctgttctgagtgaggaggacaggccctgtgtgtgatggccccacctgagccactggcatgggcagtcagttcccaagacggagtccaggacagacaaaaaatgaacagctgaaaagtgcaagtagtgtaggttcaaggaagtggtgtaggaagagggagacggaatgggatctgaggagggctgcacagcacacagtaggcggcacaaaagtctgctcagttaggtcacatgctccagaggcactcactgcaaaagagcctgaagattgaactgaaatataccatcggctttgctgagtatgaatgccaagaggagcagagagaagtcaagccctctaggtgataggcaggaacgagctgaaagaaggacataaatcttggtttgctcagacgggcctggattatacttacgttaattatgtttagtgcccttttcatgctaagaagtgtcctactttggatgataaattgtacagtcaccctaggtttaagtgatattcaggcagtctggcttggaaagtcaagtcaggagaagaaaaaaaaaaaaaaaaaaacagggaccaaggacctgaaagggaggatgtggccagagagtggggtattagtgagtttaaggtttcagatgtggtggtccaaggtggtagaaatgggaggctggcccttcatttcctggtgtctgtgttcctcaagatgagaacagggctcaaagactgagtagacagtgagccaaaatggaagtccagcaaagcatttagacagatacagaaagtgagcagaggcttggcctggtgagggaagggcaggagtccccccatttcctgagcactcagtgcacacccgatgcagtgcttcaaattctgtggctgcaggagctgtgggccttgttctgtgttggatactcggtgtttggtgtactctctggggctgtgtgagctcagtaaatatctgctgaatgaatgaagccatttcatggatgaggaagtaggcctggaggcattaattaacttgtcagtttcctatgtgtagtaaatggcaaatggagaattctaacttagatctgtctcacttcaaaggtcacactgttgatcactacaatgtattagtttgggtggtcaaaatgagacccacaataatttgttatttgtctgtgtgtgtgtgtgtgtgtgtgtgtgtgtgtgtgtgtgatttcaaaactctgctcaagcactgacagctctcgctgaatccagcagagggttctgctgcatagtcggtcaccaacgaggtgagattctgtggaagatccataatgcacagagacaggaaagtggaaagcgtacccaattgctagaatctgaagcaactgctctgagagtgttaggagaggtacaaagaagcactgcaaactcaggtgagtaggactgaaactagaagaaaaggtcggatgttggaaaggacagcaggagacacttgtgggactcagaagggcgtgaggatatggcagaggccccagtgagtgtccctgggcctctgtctgaggcagattaatacccacaaaaagtgggacaatccagattctcaaggttgccaggaatttctgtgaaaggccaaggggatggggaggcacgtgataaatttataagattctttttttaaagctctcgcaattcataaagggagctacacttaactttgaactcaagaaaataaaccacaagagagaaatgaaatgttctctttcagacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32022 - DNA, 2772 bp, Homo sapiens
gatgcagcacaacaaaagagcctgacagaaacggagtcagcccacgccaggccaaaccacaaaaagaagaaagcaggcttagatgggaagcccccttcatagctccctccccaaaaatcccttctacccatatctattgagtgcttgttatgaagaaagagagcagcacaccggccctctgtctgctgggggagactgacgagtgaacagattattccagaaacctggggtaagcaagatagtggataggggacagagggccaaagcttcctagactgatgattagctgagctgagtgataaaagagaagtcagataattacacaaaaatgagagcggcagcccagcccatgcaaaagcatggccctgaccggaagctaccaggaaggattctgatgtgcctggcctgggtggtgcctgctcccagagcctgcaagctgggttctggggaagcatcctctaggtgatagagcaggctgtagagcaagccctgttctgagtgaggaggacaggccctgtgtgtgatggccccacctgagccactggcatgggcagtcagttcccaagacggagtccaggacagacaaaaaatgaacagctgaaaagtgcaagtagtgtaggttcaaggaagtggtgtaggaagagggagacggaatgggatctgaggagggctgcacagcacacagtaggcggcacaaaagtctgctcagttaggtcacatgctccagaggcactcactgcaaaagagcctgaagattgaactgaaatataccatcggctttgctgagtatgaatgccaagaggagcagagagaagtcaagccctctaggtgataggcaggaacgagctgaaagaaggacataaatcttggtttgctcagacgggcctggattatacttacgttaattatgtttagtgcccttttcatgctaagaagtgtcctactttggatgataaattgtacagtcaccctaggtttaagtgatattcaggcagtctggcttggaaagtcaagtcaggagaagaaaaaaaaaaaaaaaaaaacagggaccaaggacctgaaagggaggatgtggccagagagtggggtattagtgagtttaaggtttcagatgtggtggtccaaggtggtagaaatgggaggctggcccttcatttcctggtgtctgtgttcctcaagatgagaacagggctcaaagactgagtagacagtgagcttggcctggtgagggaagggcaggagtccccccatttcctgagcactcagtgcacacccgatgcagtgcttcaaattctgtggctgcaggagctgtgggccttgttctgtgttggatactcggtgtttggtgtactctctggggctgtgtgagctcagtaaatatctgctgaatgaatgaagaaaatgctttggctctggaaattctccactatctgagagataggtttatttcccccatttcatggatgaggaagtaggcctggaggcattaattaacttgtcagtttcctatgtgtagtaaatggcaaatggagaattctaacttagatctgtctcacttcaaaggtcacactgttgatcactacaatgtattagtttgggtggtcaaaatgagacccacaataatttgttatttgtctgtgtgtgtgtgtgtgtgtgtgtgtgtgtgtgtgtgtgatttcaaaactctgctcaagcactgacagctctcgctgaatccagcagagggttctgctgcatagtcggtcaccaacgaggtgagattctgtggaagatccataatgcacagagacaggaaagtggaaagcgtacccaattgctagaatctgaagcaactgctctgagagtgttaggagaggtacaaagaagcactgcaaactcaggtgagtaggactgaaactagaagaaaaggtcggatgttggaaaggacagcaggagacacttgtgggactcagaagggcgtgaggatatggcagaggccccagtgagtgtccctgggcctctgtctgaggcagattaatacccacaaaaagtgggacaatccagattctcaaggttgccaggaatttctgtgaaaggccaaggggatggggaggcacgtgataaatttataagattctttttttaaagctctcgcaattcataaagggagctacacttaactttgaactcaagaaaataaaccacaagagagaaatgaaatgttctctttcagacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32023 - DNA, 2065 bp, Homo sapiens
gcagcctgaggcagagctcgggggctgtcggtggggaccttgcaggagggcaccccaagcccgcccggcccgcccaacccagcccctgcgcgcagcccgggccgagtaggaccccgcgcgcccctcgccatggcggcgccctcgcggctcctgatccgcgggggtcgcgtggtcaacgatgacttctcggaggtggccgacgtgctggtggaggacggcgtggtgcgggcactcgggcacgacctgctgcctcccgggggcgctcctgcggggctgcgggtcctcgacgccgccggcaagctcgtcctgcccggaggcatcgacacacacacgcacatgcagttccccttcatgggctcgcggtccatcgacgacttccaccagggcaccaaggctgctctctcaggaggcaccaccatgattattgatttcgccattcctcagaaaggtggctccctcattgaggccttcgagacctggcgaagctgggctgatcccaaagtttgctgcgactacagccttcatgtggcagtgacgtggtggagtgaccaggttaaagaagaaatgaaaatccttgtgcaagataaaggtgttaactctttcaagatgtttatggcctataaagatctgtacatggtgacagacctggagctgtacgaagccttctctcggtgcaaggaaattggagcaattgcccaggtccatgcggaaaatggagacttaattgcagagggagcaaagaagatgttggctctggggataacaggccctgagggccacgagctgtgccgcccagaggcagtggaggcagaggccacgctgagagccatcaccatagccagcgctgtgaactgtcctctctacattgtgcatgtgatgagcaagtctgcagctaaggtgatagcggatgcaaggagagatgggaaggtggtctatggtgaacccatagcagccagtcttggcacagatggcactcactactggaataaagaatggcaccatgcagcccaccatgtcatgggtccacctttgcgaccagacccctcaacacccgacttcctcatgaatctgttggctaatgatgatctaaccacaacagggactgataactgcactttcaacacctgccagaaagctcttgggaaggatgattttaccaagatccccaatggggtgaatggtgttgaagatcggatgtccgtaatatgggaaaaaggcgtgcatagtggtaaaatggatgaaaacagatttgtggcagttaccagcacaaatgcagccaaaatttttaatctctatccaagaaaaggaagaatagctgtaggatcagatgctgacattgttatttgggacccaaaaggcacaagggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccggacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32024 - DNA, 2807 bp, Homo sapiens
gatgcagcacaacaaaagagcctgacagaaacggagtcagcccacgccaggccaaaccacaaaaagaagaaagcaggcttagatgggaagcccccttcatagctccctccccaaaaatcccttctacccatatctattgagtgcttgttatgaagaaagagagcagcacaccggccctctgtctgctgggggagactgacgagtgaacagattattccagaaacctggggtaagcaagatagtggataggggacagagggccaaagcttcctagactgatgattagctgagctgagtgataaaagagaagtcagataattacacaaaaatgagagcggcagcccagcccatgcaaaagcatggccctgaccggaagctaccaggaaggattctgatgtgcctggcctgggtggtgcctgctcccagagcctgcaagctgggttctggggaagcatcctctaggtgatagagcaggctgtagagcaagccctgttctgagtgaggaggacaggccctgtgtgtgatggccccacctgagccactggcatgggcagtcagttcccaagacggagtccaggacagacaaaaaatgaacagctgaaaagtgcaagtagtgtaggttcaaggaagtggtgtaggaagagggagacggaatgggatctgaggagggctgcacagcacacagtaggcggcacaaaagtctgctcagttaggtcacatgctccagaggcactcactgcaaaagagcctgaagattgaactgaaatataccatcggctttgctgagtatgaatgccaagaggagcagagagaagtcaagccctctaggtgataggcaggaacgagctgaaagaaggacataaatcttggtttgctcagacgggcctggattatacttacgttaattatgtttagtgcccttttcatgctaagaagtgtcctactttggatgataaattgtacagtcaccctaggtttaagtgatattcaggcagtctggcttggaaagtcaagtcaggagaagaaaaaaaaaaaaaaaaaaacagggaccaaggacctgaaagggaggatgtggccagagagtggggtattagtgagtttaaggtttcagatgtggtggtccaaggtggtagaaatgggaggctggcccttcatttcctggtgtctgtgttcctcaagatgagaacagggctcaaagactgagtagacagtgagccaaaatggaagtccagcaaagcatttagacagatacagaaagtgagcagaggcttggcctggtgagggaagggcaggagtccccccatttcctgagcactcagtgcacacccgatgcagtgcttcaaattctgtggctgcaggagctgtgggccttgttctgtgttggatactcggtgtttggtgtactctctggggctgtgtgagctcagtaaatatctgctgaatgaatgaagaaaatgctttggctctggaaattctccactatctgagagataggtttatttcccccatttcatggatgaggaagtaggcctggaggcattaattaacttgtcagtttcctatgtgtagtaaatggcaaatggagaattctaacttagatctgtctcacttcaaaggtcacactgttgatcactacaatgtattagtttgggtggtcaaaatgagacccacaataatttgttatttgtctgtgtgtgtgtgtgtgtgtgatttcaaaactctgctcaagcactgacagctctcgctgaatccagcagagggttctgctgcatagtcggtcaccaacgaggtgagattctgtggaagatccataatgcacagagacaggaaagtggaaagcgtacccaattgctagaatctgaagcaactgctctgagagtgttaggagaggtacaaagaagcactgcaaactcaggtgagtaggactgaaactagaagaaaaggtcggatgttggaaaggacagcaggagacacttgtgggactcagaagggcgtgaggatatggcagaggccccagtgagtgtccctgggcctctgtctgaggcagattaatacccacaaaaagtgggacaatccagattctcaaggttgccaggaatttctgtgaaaggccaaggggatggggaggcacgtgataaatttataagattctttttttaaagctctcgcaattcataaagggagctacacttaactttgaactcaagaaaataaaccacaagagagaaatgaaatgttctctttcagacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32025 - DNA, 2752 bp, Homo sapiens
gatgcagcacaacaaaagagcctgacagaaacggagtcagcccacgccaggccaaaccacaaaaagaagaaagcaggcttagatgggaagcccccttcatagctccctccccaaaaatcccttctacccatatctattgagtgcttgttatgaagaaagagagcagcacaccggccctctgtctgctgggggagactgacgagtgaacagattattccagaaacctggggtaagcaagatagtggataggggacagagggccaaagcttcctagactgatgattagctgagctgagtgataaaagagaagtcagataattacacaaaaatgagagcggcagcccagcccatgcaaaagcatggccctgaccggaagctaccaggaaggattctgatgtgcctggcctgggtggtgcctgctcccagagcctgcaagctgggttctggggaagcatcctctaggtgatagagcaggctgtagagcaagccctgttctgagtgaggaggacaggccctgtgtgtgatggccccacctgagccactggcatgggcagtcagttcccaagacggagtccaggacagacaaaaaatgaacagctgaaaagtgcaagtagtgtaggttcaaggaagtggtgtaggaagagggagacggaatgggatctgaggagggctgcacagcacacagtaggcggcacaaaagtctgctcagttaggtcacatgctccagaggcactcactgcaaaagagcctgaagattgaactgaaatataccatcggctttgctgagtatgaatgccaagaggagcagagagaagtcaagccctctaggtgataggcaggaacgagctgaaagaaggacataaatcttggtttgctcagacgggcctggattatacttacgttaattatgtttagtgcccttttcatgctaagaagtgtcctactttggatgataaattgtacagtcaccctaggtttaagtgatattcaggcagtctggcttggaaagtcaagtcaggagaagaaaaaaaaaaaaaaaaaaacagggaccaaggacctgaaagggaggatgtggccagagagtggggtattagtgagtttaaggtttcagatgtggtggtccaaggtggtagaaatgggaggctggcccttcatttcctggtgtctgtgttcctcaagatgagaacagggctcaaagactgagtagacagtgagccaaaatggaagtccagcaaagcatttagacagatacagaaagtgagcagaggcttggcctggtgagggaagggcaggagtccccccatttcctgagcactcagtgcacacccgatgcagtgcttcaaattctgtggctgcaggagctgtgggccttgttctgtgttggatactcggtgtttggtgtactctctggggctgtgtgagctcagtaaatatctgctgaatgaatgaagaaaatgctttggctctggaaattctccactatctgagagataggtttatttcccccatttcatggatgaggaagtaggcctggaggcattaattaacttgtcagtttcctatgtgtagtaaatggcaaatggagaattctaacttagatctgtctcacttcaaaggtcacactgttgatcactacaatgtattagtttgggtggtcaaaatgagacccacaataatttgttatttgtctgtgtgtgtgtgtgtgtgtgatttcaaaactctgctcaagcactgacagctctcgctgaatccagcagagggttctgctgcatagtcggtcaccaacgaggtgagattctgtggaagatccataatgcacagagacaggaaagtggaaagcgtacccaattgctagaatctgaagcaactgctctgagagtgttaggagaggtacaaagaagcactgcaaactcaggtgagtaggactgaaactagaaggtgaggatatggcagaggccccagtgagtgtccctgggcctctgtctgaggcagattaatacccacaaaaagtgggacaatccagattctcaaggttgccaggaatttctgtgaaaggccaaggggatggggaggcacgtgataaatttataagattctttttttaaagctctcgcaattcataaagggagctacacttaactttgaactcaagaaaataaaccacaagagagaaatgaaatgttctctttcagacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32026 - DNA, 918 bp, Homo sapiens
ctgtaggaattggcacgagatttgggacccaaaaggcacacgaggatgtagaagttgtgttgcattctctgacaatggatctgtatataaaaccaatatgaatttaccacttcagtgcctggcaaatgcccgagttcacatggaagaaaggactatctcagcaaaaactcatcatcaggctgttaacttcaacattttcgagggcatggtttgccacggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccggacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32027 - DNA, 835 bp, Homo sapiens
ggaagggcctccccagatgtgctcttgaggccagctgtctgcgtggaggaggcacctcctggaaggggactatctcagcaaaaactcatcatcaggctgttaacttcaacattttcgagggcatggtttgccacggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccggacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32028 - DNA, 4111 bp, Homo sapiens
gatgcagcacaacaaaagagcctgacagaaacggagtcagcccacgccaggccaaaccacaaaaagaagaaagcaggcttagatgggaagcccccttcatagctccctccccaaaaatcccttctacccatatctattgagtgcttgttatgaagaaagagagcagcacaccggccctctgtctgctgggggagactgacgagtgaacagattattccagaaacctggggtaagcaagatagtggataggggacagagggccaaagcttcctagactgatgattagctgagctgagtgataaaagagaagtcagataattacacaaaaatgagagcggcagcccagcccatgcaaaagcatggccctgaccggaagctaccaggaaggattctgatgtgcctggcctgggtggtgcctgctcccagagcctgcaagctgggttctggggaagcatcctctaggtgatagagcaggctgtagagcaagccctgttctgagtgaggaggacaggccctgtgtgtgatggccccacctgagccactggcatgggcagtcagttcccaagacggagtccaggacagacaaaaaatgaacagctgaaaagtgcaagtagtgtaggttcaaggaagtggtgtaggaagagggagacggaatgggatctgaggagggctgcacagcacacagtaggcggcacaaaagtctgctcagttaggtcacatgctccagaggcactcactgcaaaagagcctgaagattgaactgaaatataccatcggctttgctgagtatgaatgccaagaggagcagagagaagtcaagccctctaggtgataggcaggaacgagctgaaagaaggacataaatcttggtttgctcagacgggcctggattatacttacgttaattatgtttagtgcccttttcatgctaagaagtgtcctactttggatgataaattgtacagtcaccctaggtttaagtgatattcaggcagtctggcttggaaagtcaagtcaggagaagaaaaaaaaaaaaaaaaaaacagggaccaaggacctgaaagggaggatgtggccagagagtggggtattagtgagtttaaggtttcagatgtggtggtccaaggtggtagaaatgggaggctggcccttcatttcctggtgtctgtgttcctcaagatgagaacagggctcaaagactgagtagacagtgagccaaaatggaagtccagcaaagcatttagacagatacagaaagtgagcagaggcttggcctggtgagggaagggcaggagtccccccatttcctgagcactcagtgcacacccgatgcagtgcttcaaattctgtggctgcaggagctgtgggccttgttctgtgttggatactcggtgtttggtgtactctctggggctgtgtgagctcagtaaatatctgctgaatgaatgaagaaaatgctttggctctggaaattctccactatctgagagataggtttatttcccccatttcatggatgaggaagtaggcctggaggcattaattaacttgtcagtttcctatgtgtagtaaatggcaaatggagaattctaacttagatctgtctcacttcaaaggtcacactgttgatcactacaatgtattagtttgggtggtcaaaatgagacccacaataatttgttatttgtctgtgtgtgtgtgtgtgtgtgtgtgtgtgtgtgtgtgtgatttcaaaactctgctcaagcactgacagctctcgctgaatccagcagagggttctgctgcatagtcggtcaccaacgaggtgagattctgtggaagatccataatgcacagagacaggaaagtggaaagcgtacccaattgctagaatctgaagcaactgctctgagagtgttaggagaggtacaaagaagcactgcaaactcaggtgagtaggactgaaactagaagaaaaggtcggatgttggaaaggacagcaggagacacttgtgggactcagaagggcgtgaggatatggcagaggccccagtgagtgtccctgggcctctgtctgaggcagattaatacccacaaaaagtgggacaatccagattctcaaggttgccaggaatttctgtgaaaggccaaggggatggggaggcacgtgataaatttataagattctttttttaaagctctcgcaattcataaagggagctacacttaactttgaactcaagaaaataaaccacaagagagaaatgaaatgttctctttcagacttgcacacctacccctgtggagcgtgcaccctataagggagaagtcgccacactgaaatccagagtgacaaaagaagatgccacagcagggaccaggaaacaggcccacccctgaagtgtgtgccatcggtaagggactgtaggcaagaaaagtcttcctgcatgacagcatatgaaattagcatctctcctcataagggttgaagagatcaaggtcagaggcttcacagtgatccaagactcaaggacaattgagccaagggaagattgatcaaagcagaacatttagataagccttccagattgtagaaggccttgggcttgctagagagtcattctttaagatgttaggaaacattcaatacagccttggataatcaactatgagcaagttgcactaaggaggctgataacatacagagggaactacttaagacagggagtataatttcatggtcaaaatttacaaatgaattaggaccttatctggagaaatgaatcttcatattgtaaatacaacggtgttctaaaatttagaataaatgaaaaatgaataaaatgttgctttaggggatataatccttcagaaaaattctttgatagtatctgattatttcacagttagttttgggaataatattacagatacagtcatttttgccttttctgaagtgcctcgtatcatcatccttgtcaattttctttcttcagttgtcttctggtcctgctctctcagatcctcatttaacagcggctttgctgtaattttagcatctccctaatatcacttccactgacttcatgaaatctacatgttttgccagttttgcaattttgctaggctcttaatttttttttaacgtgtgatatcttttcagacagttcaacacgtggccatctgcacaagacttaaccccagaggttgacctaatggacctggttagacatttgtgttaatgagaggcacagtttgacaacggtctggttttctacatattcaggcactgcaccttttcacattttgacaacctcttattccctgcataaatcctgttcctgcagggatttggataatgagggcttgaatggcaaagccctctgtgctacatgccatgttctttcattattgaatgttgtgtctttaacaggactatctagcccaaagtctcaacatttttgtcattttcagacgaccagaattattcttctaatctaggatgattttgttaaaaattcagggaaagattagcaagagaaaggaatgcgattcaatgctataacatgctattaatgacatttataggagcaggattagtgtttactttgattatagcatttcttgggggttaggtttgaattctgcatctctttgtgagggagaatgttacagtgagttcctttcattctcttcaaaggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32029 - DNA, 2001 bp, Homo sapiens
gcagcctgaggcagagctcgggggctgtcggtggggaccttgcaggagggcaccccaagcccgcccggcccgcccaacccagcccctgcgcgcagcccgggccgagtaggaccccgcgcgcccctcgccatggcggcgccctcgcggctcctgatccgcgggggtcgcgtggtcaacgatgacttctcggaggtggccgacgtgctggtggaggacggcgtggtgcgggcactcgggcacgacctgctgcctcccgggggcgctcctgcggggctgcgggtcctcgacgccgccggcaagctcgtcctgcccggaggcatcgacacacacacgcacatgcagttccccttcatgggctcgcggtccatcgacgacttccaccagggcaccaaggctgctctctcaggaggcaccaccatgattattgatttcgccattcctcagaaaggtggctccctcattgaggccttcgagacctggcgaagctgggctgatcccaaagtttgctgcgactacagccttcatgtggcagtgacgtggtggagtgaccaggttaaagaagaaatgaaaatccttgtgcaagataaaggtgttaactctttcaagatgtttatggcctataaagatctgtacatggtgacagacctggagctgtacgaagccttctctcggtgcaaggaaattggagcaattgcccaggtccatgcggaaaatggagacttaattgcagagggagcaaagaagatgttggctctggggataacaggccctgagggccacgagctgtgccgcccagaggcagtggaggcagaggccacgctgagagccatcaccatagccagcgctgtgaactgtcctctctacattgtgcatgtgatgagcaagtctgcagctaaggtgatagcggatgcaaggagagatgggaaggtggtctatggtgaacccatagcagccagtcttggcacagatggcactcactactggaataaagaatggcaccatgcagcccaccatgtcatgggtccacctttgcgaccagacccctcaacacccgacttcctcatgaatctgttggctaatgatgatctaaccacaacagggactgataactgcactttcaacacctgccagaaagctcttgggaaggatgattttaccaagatccccaatggggtgaatggtgttgaagatcggatgtccgtaatatgggaaaaaggcgtgcatagtggtaaaatggatgaaaacagatttgtggcagttaccagcacaaatgcagccaaaatttttaatctctatccaagaaaaggaagaatagctgtaggatcagatgctgacattgttatttgggacccaaaaggcacaaggactatctcagcaaaaactcatcatcaggctgttaacttcaacattttcgagggcatggtttgccacggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccgggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32030 - DNA, 2078 bp, Homo sapiens
gcagcctgaggcagagctcgggggctgtcggtggggaccttgcaggagggcaccccaagcccgcccggcccgcccaacccagcccctgcgcgcagcccgggccgagtaggaccccgcgcgcccctcgccatggcggcgccctcgcggctcctgatccgcgggggtcgcgtggtcaacgatgacttctcggaggtggccgacgtgctggtggaggacggcgtggtgcgggcactcgggcacgacctgctgcctcccgggggcgctcctgcggggctgcgggtcctcgacgccgccggcaagctcgtcctgcccggaggcatcgacacacacacgcacatgcagttccccttcatgggctcgcggtccatcgacgacttccaccagggcaccaaggctgctctctcaggaggcaccaccatgattattgatttcgccattcctcagaaaggtggctccctcattgaggccttcgagacctggcgaagctgggctgatcccaaagtttgctgcgactacagccttcatgtggcagtgacgtggtggagtgaccaggttaaagaagaaatgaaaatccttgtgcaagataaaggtgttaactctttcaagatgtttatggcctataaagatctgtacatggtgacagacctggagctgtacgaagccttctctcggtgcaaggaaattggagcaattgcccaggtccatgcggaaaatggagacttaattgcagagggagcaaagaagatgttggctctggggataacaggccctgagggccacgagctgtgccgcccagaggcagtggaggcagaggccacgctgagagccatcaccatagccagcgctgtgaactgtcctctctacattgtgcatgtgatgagcaagtctgcagctaaggtgatagcggatgcaaggagagatgggaaggtggtctatggtgaacccatagcagccagtcttggcacagatggcactcactactggaataaagaatggcaccatgcagcccaccatgtcatgggtccacctttgcgaccagacccctcaacacccgacttcctcatgaatctgttggctaatgatgatctaaccacaacagggactgataactgcactttcaacacctgccagaaagctcttgggaaggatgattttaccaagatccccaatggggtgaatggtgttgaagatcggatgtccgtaatatgggaaaaaggcgtgcatagtggtaaaatggatgaaaacagatttgtggcagttaccagcacaaatgcagccaaaatttttaatctctatccaagaaaaggaagaatagctgtaggatcagatgctgacattgttatttgggacccaaaaggcacaaggactatctcagcaaaaactcatcatcaggctgttaacttcaacattttcgagggcatggtttgccacggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccggacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaatctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgat

SEQ ID NO: 32031 - DNA, 1479 bp, Homo sapiens
gcagcctgaggcagagctcgggggctgtcggtggggaccttgcaggagggcaccccaagcccgcccggcccgcccaacccagcccctgcgcgcagcccgggccgagtaggaccccgcgcgcccctcgccatggcggcgccctcgcggctcctgatccgcgggggtcgcgtggtcaacgatgacttctcggaggtggccgacgtgctggtggaggacggcgtggtgcgggcactcgggcacgacctgctgcctcccgggggcgctcctgcggggctgcgggtcctcgacgccgccggcaagctcgtcctgcccggaggcatcgacacacacacgcacatgcagttccccttcatgggctcgcggtccatcgacgacttccaccagggcaccaaggctgctctctcaggaggcaccaccatgattattgatttcgccattcctcagaaaggtggctccctcattgaggccttcgagacctggcgaagctgggctgatcccaaagtttgctgcgactacagccttcatgtggcagtgacgtggtggagtgaccaggttaaagaagaaatgaaaatccttgtgcaagataaaggtgttaactctttcaagatgtttatggcctataaagatctgtacatggtgacagacctggagctgtacgaagccttctctcggtgcaaggaaattggagcaattgcccaggtccatgcggaaaatggagacttaattgcagagggagcaaagaagatgttggctctggggataacaggccctgagggccacgagctgtgccgcccagaggcagtggaggcagaggccacgctgagagccatcaccatagccagcgctgtgaactgtcctctctacattgtgcatgtgatgagcaagtctgcagctaaggtgatagcggatgcaaggagagatgggaaggtggtctatggtgaacccatagcagccagtcttggcacagatggcactcactactggaataaagaatggcaccatgcagcccaccatgtcatgggtccacctttgcgaccagacccctcaacacccgacttcctcatgaatctgttggctaagtaatcattttgcagatgactgggaagtgtattgccaaaagaaggtttgggtagaagggagctcgtcctcccatctggatcctccactaacctcccagtattctcttctacttgacctgtcaggtcctgggtacccctcacctgcagagcaaaaaacattgacttaattatgctgtgatatgttgtcaaagcctttcctagactctcagaaatcagatcgttttcactgaaactttactcttttctgacttttttcatctcttgttgcccaaacccagggctcttcattacaccttactttttatcagaatattgttgaatttttttctatgctgatataatatgggaactaggttaaccctgttactttctgggaacatatgatcatttttcttgaaaa

SEQ ID NO: 32032 - DNA, 550 bp, Homo sapiens
cactgaccttctgggtaatctgtcatgacgacctgatagcagaccggcaggatgctccaaactgtcaccaaagatgtcacgagtgcttctgaggctcaagaatctaattttccttacttaaaataaaaggactgaatgctggatgaataaccctttttttcaccccctaaacaaatctcatagggaatcctaatatataaaataaccaaagtgcaagccctgggttaaagccgaggatgggtgctagagatgggctagagcatgtctgcttagctttcttccactatcccagccatttaaagaccacaagttagcttcctggaattcagtttgacaaacacttaggctagatcattgtcaggggaccttcatttcaagctccatggagtaggtcggggactctgccttggtcatccctgaatccccacagccatggttctagcacacagtaagcactaaaaaccaaaacccaaaaacccgtatgataatgtatgtctacagacattcgatgaatggatgaataaaagatttttcagataccatgaaaaaa

SEQ ID NO: 32033 - DNA, 5850 bp, Homo sapiens
ggcggccgccgtcctcttgcgcaggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacatactctttggttctggacaattgcattaataagatggtaaataatctgagctcagaagtgaaagaacgacgaattgttctcattagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgataactcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcatttgaatgtttccaaatctattttatctgacgtcatgaacacacaggcaatgattttatgacaacttgatgtgcttttttctttatttttcttttacattagaagttttctctcttttctccacctctcctttatttttaattttaattttaatttttgaaacaagatctgactctgttgcccaagctggagtacagtagtgcaatctcagctcactgcaacctccacctcccagactcaagccatcctcccacctcaacctcccaagtagctgggactacaggcatatgccatcacacccagctaatttttgtttttctgtagagacagggtttcaccatgttggccaggctggtctcaaattcctgaccttaagtgatccacctgcctaggcctctaaaatgctgggattacaggcgtgagccaccacgcccagcctataccccatgtattttcataaagggttggaaactattgattgccaactttttaaggatggtagggattttttctttgttgaatatactgtgaattttgggattctggagtccttagtcttcatttccattcttctgcccatgattactgatcaaaatactggtagagtcatggaggaagtaagttaaatgtggaaaaaatgctttaaaagtacttactataaccacatcataagaattctggaaaaatagagaacaaaaggaaaagattgttaccaccttgatttaataacttcttgtttccccatacatgtgttttgtttatagattgcatgggtatatgtcaatttttatatgttctgtgtttagtttacatattgtaattcatttttaagagagtacagacatacactttttgagtaggcaatatgttcacatagtttgaaattaaaggtacaaaatggcgtagaatgaaatgcctctcaccctttccccacagcgactacttcccactcagaggcaacaagtattacagttgcttgtatattcttccagagatctctgtctatacaagcaaaaacacatgtggtctttttccttgctttgcacaaatggtaaactgtacgctattctgaaccttgcttttttcagatatatgttggcaacagttccatgtcagtacatagtttcctttctttattacagctgcctgttttttcattgtgtatttgcaccatcatttacttttctggcttacttttgatagaaatctaggttggttcaaacctttttactcttaaaacaatgctgcagttaacacccttgtacatatatctttagagagaagatattttaaaaagaaatacctttttaaaaattattttattattttttaatagagactatgttgcctaggctggtcttgaaattctgggctaaagcaatcctaccaccttggcctcccaaagtgctgagattacaggcatgagccattgcacctggccaagaagagacatcttgacttgagcctgaagactatgtacagagactgacctcacagactgaccattccatcccacagctgctggacatagagtgatttgcagcccctcctttcagagtaccacatccctctcaagtgttccacaacatctaggaaagtgagctcttaaagacagactaaaaagagtaataaatcaatacaacaacattaaaagccagactagcggagtttgaatcttggccctgctgttagtaactgtgtgagccttgggcaagttactcagcctccttgtgtcttggttttggtttcttcatctctaagtaattatatctgtcattattgccctgatcacaaacaaaagcctgaatgtactatgtttaaaagacaaaccaaaaattaacccaaacttgcattatttgtctgagctacagaatgttctttccttggagagatatctgatattaaacatcatctgcattttacttgcctagaaaatacacggtaacttttctgccttgcagcatcaaactatagtacagctgagccccagtgctgtgcagtctgactctaattaaaggcaccttctttacagcagggctctggggaactggaaaagggggtttgtttcattatctggttttattaagcagatgaatgcagccagctatatgaagcactttgcagtgaatggcaggtgtcccatatctggttatgttaacctagaaagggctcactctacctctaggcatgtttcatcccaacaatcagactgtgccaaagcaggggactttgtcctttgtggattgcatagctggatacccatcatctgtttctctgattggaagctgctgttgtacagaaagacctgcatttcccccttgtctccagttctctcactactttttcctcctctgtgagtgaccatccaggcagtcaccataactgctggagtgtctgggattggtagctctctccaactgcctgcttgctctttacagcctctctctgtgactggaatctctccacctcatcgtatctaaggataacccagaaacatggggtgtcctaggtatgtttatctcgacactgaaccccctaggcttctgatgaatccagtgattagctaaatttgacatagaaagtaagaaggaatgtctactttgtattgtggtcctaatctaagatcaggagaatcctggaattgttatctgtctcttgctctgagatacagacttgttcataggtgtggggcctgattggaacaggatctgccattggtcacaataggtcaagggcttgttctgaaccctagttagcttcattcagagaaagaaacttcctacctggtcagctttttcagcttctccaacaaatgggagttgaggcagtaggagtgtggggttcttgggaagacgatggggccttgtattaaggagaaataatgaactatcttcttgattcttccattgagaaaagcatatgaatcctaggaaagggctcagcctgtgataggcattcaataaatactccaatgctgtcattcctttgtctacagcatccccaaacaatgtaccagtgatgggctacctgagctcatctagtcgccaagcagtatctcctgcttgctgctgctttactacattccagatgcccacctcatccaatttccagagccactatctctgctgtccactttccttcaggctctgtgaatacttcaacctgctgtgatttggggccgtttgtactctgcatgtattcaataaattcaattcagcaatagttatcaaatgcccattttcttactaggcactgctctaggtgtttggtatggcaatgagcaaaacacaaccattgtgagctgatgttctagaaaggtgtcaaaagcgtttcaaaggttttatgagatgctgtgggagggggttacgcactgctacctactgaggtagcaatgttgggtgtttcctcacattcctcaacctccacgcag

SEQ ID NO: 32034 - DNA, 546 bp, Homo sapiens
ggtgctgcggtgatctcgaggattccgacgagttgtccgagttagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgataactcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctg

SEQ ID NO: 32035 - DNA, 908 bp, Homo sapiens
  misc_feature (774)..(774): n is a, c, g, or t
  misc_feature (786)..(786): n is a, c, g, or t
  misc_feature (813)..(813): n is a, c, g, or t
  misc_feature (816)..(816): n is a, c, g, or t
aattaggctaggtacgaggctgggggtgaatcggccgagggaatacttcatgctgtcaccttgaactgtgcccacagtttctgctcctactgtatcaatgaatggatgaagcggaagatagaatgccccatttgtcggaaggacattaagtccaaaacatactctttggttctggacaattgcattaataagatggtaaataatctgagctcagaagtgaaagaacgacgaattgttctcattagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgataactcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgaaaaaaaaaaaaaacaaaaaaaaacccncgggccataatncggggggcgggaaaaagcggtttcaanggnccgtggccaagggtcccggcacccttttttgcacaaggggaatcggccggcccaaaaggggcgataacgaaacggcgatctaccaaacacct

SEQ ID NO: 32036 - DNA, 432 bp, Homo sapiens
ggtgctgcggtgatctcgaggattccgacgagttgtccgagttagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgataactcggacaactcgtcggggatcctcggagttacc

SEQ ID NO: 32037 - DNA, 468 bp, Homo sapiens
ggcggccgccgtcctcttgcgcaggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtacgggggaaggggtcctgtggagcggagggcaggggctggagggagcggggctccggggagggaggaaggtgtcttgctgggctgaatgaatggcagagaggaggcgggcatcaggaagaggagcgaagtgtctgtggggggggtgg

SEQ ID NO: 32038 - DNA, 2139 bp, Homo sapiens
ggcggccgccgtcctcttgcgcaggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacatactctttggttctggacaattgcattaataagatggtaaataatctgagctcagaagtgaaagaacgacgaattgttctcattagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgataactcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctg

SEQ ID NO: 32039 - DNA, 2301 bp, Homo sapiens
  misc_feature (2167)..(2167): n is a, c, g, or t
  misc_feature (2179)..(2179): n is a, c, g, or t
  misc_feature (2206)..(2206): n is a, c, g, or t
  misc_feature (2209)..(2209): n is a, c, g, or t
ggcggccgccgtcctcttgcgcaggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacatactctttggttctggacaattgcattaataagatggtaaataatctgagctcagaagtgaaagaacgacgaattgttctcattagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgataactcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgaaaaaaaaaaaaaacaaaaaaaaacccncgggccataatncggggggcgggaaaaagcggtttcaanggnccgtggccaagggtcccggcacccttttttgcacaaggggaatcggccggcccaaaaggggcgataacgaaacggcgatctaccaaacacct

SEQ ID NO: 32040 - DNA, 5760 bp, Homo sapiens
ggcggccgccgtcctcttgcgcaggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacatactctttggttctggacaattgcattaataagatggtaaataatctgagctcagaagtgaaagaacgacgaattgttctcattagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgataactcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcatttgaatgtttccaaatctattttatctgacgtcatgaacacacaggcaatgattttatgacaacttgatgtgcttttttctttatttttcttttacattagaagttttctctcttttctccacctctcctttatttttaattttaattttaatttttgaaacaagatctgactctgttgcccaagctggagtacagtagtgcaatctcagctcactgcaacctccacctcccagactcaagccatcctcccacctcaacctcccaagtagctgggactacaggcatatgccatcacacccagctaatttttgtttttctgtagagacagggtttcaccatgttggccaggctggtctcaaattcctgaccttaagtgatccacctgcctaggcctctaaaatgctgggattacaggcgtgagccaccacgcccagcctataccccatgtattttcataaagggttggaaactattgattgccaactttttaaggatggtagggattttttctttgttgaatatactgtgaattttgggattctggagtccttagtcttcatttccattcttctgcccatgattactgatcaaaatactggtagagtcatggaggaagtaagttaaatgtggaaaaaatgctttaaaagtacttactataaccacatcataagaattctggaaaaatagagaacaaaaggaaaagattgttaccaccttgatttaataacttcttgtttccccatacatgtgttttgtttatagattgcatgggtatatgtcaatttttatatgttctgtgtttagtttacatattgtaattcatttttaagagagtacagacatacactttttgagtaggcaatatgttcacatagtttgaaattaaaggtacaaaatggcgtagaatgaaatgcctctcaccctttccccacagcgactacttcccactcagaggcaacaagtattacagttgcttgtatattcttccagagatctctgtctatacaagcaaaaacacatgtggtctttttccttgctttgcacaaatggtaaactgtacgctattctgaaccttgcttttttcagatatatgttggcaacagttccatgtcagtacatagtttcctttctttattacagctgcctgttttttcattgtgtatttgcaccatcatttacttttctggcttacttttgatagaaatctaggttggttcaaacctttttactcttaaaacaatgctgcagttaacacccttgtacatatatctttagagagaagatattttaaaaagaaatacctttttaaaaattattttattattttttaatagagactatgttgcctaggctggtcttgaaattctgggctaaagcaatcctaccaccttggcctcccaaagtgctgagattacaggcatgagccattgcacctggccaagaagagacatcttgacttgagcctgaagactatgtacagagactgacctcacagactgaccattccatcccacagctgctggacatagagtgatttgcagcccctcctttcagagtaccacatccctctcaagtgttccacaacatctaggaaagtgagctcttaaagacagactaaaaagagtaataaatcaatacaacaacattaaaagccagactagcggagtttgaatcttggccctgctgttagtaactgtgtgagccttgggcaagttactcagcctccttgtgtcttggttttggtttcttcatctctaagtaattatatctgtcattattgccctgatcacaaacaaaagcctgaatgtactatgtttaaaagacaaaccaaaaattaacccaaacttgcattatttgtctgagctacagaatgttctttccttggagagatatctgatattaaacatcatctgcattttacttgcctagaaaatacacggtaacttttctgccttgcagcatcaaactatagtacagctgagccccagtgctgtgcagtctgactctaattaaaggcaccttctttacagcagggctctggggaactggaaaagggggtttgtttcattatctggttttattaagcagatgaatgcagccagctatatgaagcactttgcagtgaatggcaggtgtcccatatctggttatgttaacctagaaagggctcactctacctctaggcatgtttcatcccaacaatcagactgtgccaaagcaggggactttgtcctttgtggattgcatagctggatacccatcatctgtttctctgattggaagctgctgttgtacagaaagacctgcatttcccccttgtctccagttctctcactactttttcctcctctgtgagtgaccatccaggcagtcaccataactgctggagtgtctgggattggtagctctctccaactgcctgcttgctctttacagcctctctctgtgactggaatctctccacctcatcgtatctaaggataacccagaaacatggggtgtcctaggtatgtttatctcgacactgaaccccctaggcttctgatgaatccagtgattagctaaatttgacatagaaagtaagaaggaatgtctactttgtattgtggtcctaatctaagatcaggagaatcctggaattgttatctgtctcttgctctgagatacagacttgttcataggtgtggggcctgattggaacaggatctgccattggtcacaataggtcaagggcttgttctgaaccctagttagcttcattcagagaaagaaacttcctacctggtcagctttttcagcttctccaacaaatgggagttgaggcagtaggagtgtggggttcttgggaagacgatggggccttgtattaaggagaaataatgaactatcttcttgattcttccattgagaaaagcatatgaatcctaggaaagggctcagcctgtgataggcattcaataaatactccaatgctgtcattcctttgtctacagcatccccaaacaatgtaccagtgatgggctacctgagctcatctagtcgccaagcagtatctcctgcttgctgctgctttactacattccagatgcccacctcatccaatttccagagccactatctctgctgtccactttccttcaggctctgtgaatacttcaacctgctgtgatttggggccgtttgtactctgcatgtattcaataaattcaattcagcaatagttatcaaatgcccattttcttactaggcactgctctaggtgtttggtatggcaatgagcaaaacacaaccattgtgagctgatgttctagaaaggtgtcaaaagcgtttcaaaggttttatgagatgctgtgggagggggttacgcactgctacctactgaggtagcaatgttgggtgtttcctcacattcctcaacctccacgcag

SEQ ID NO: 32041 - DNA, 2025 bp, Homo sapiens
ggcggccgccgtcctcttgcgcaggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacatactctttggttctggacaattgcattaataagatggtaaataatctgagctcagaagtgaaagaacgacgaattgttctcattagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgataactcggacaactcgtcggggatcctcggagttacc

SEQ ID NO: 32042 - DNA, 6010 bp, Homo sapiens
ggcggccgccgtcctcttgcgcaggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgagggttgttatgaactagactggtccaacaggaaagtatgatagatgtgaactggggcttcttttcaaccttttccggaagctctcaagctgttcttgtggataagacagagaatatgtactccaatgcaaagacttttggttgaattataactggctgaaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacatactctttggttctggacaattgcattaataagatggtaaataatctgagctcagaagtgaaagaacgacgaattgttctcattagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgataactcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcatttgaatgtttccaaatctattttatctgacgtcatgaacacacaggcaatgattttatgacaacttgatgtgcttttttctttatttttcttttacattagaagttttctctcttttctccacctctcctttatttttaattttaattttaatttttgaaacaagatctgactctgttgcccaagctggagtacagtagtgcaatctcagctcactgcaacctccacctcccagactcaagccatcctcccacctcaacctcccaagtagctgggactacaggcatatgccatcacacccagctaatttttgtttttctgtagagacagggtttcaccatgttggccaggctggtctcaaattcctgaccttaagtgatccacctgcctaggcctctaaaatgctgggattacaggcgtgagccaccacgcccagcctataccccatgtattttcataaagggttggaaactattgattgccaactttttaaggatggtagggattttttctttgttgaatatactgtgaattttgggattctggagtccttagtcttcatttccattcttctgcccatgattactgatcaaaatactggtagagtcatggaggaagtaagttaaatgtggaaaaaatgctttaaaagtacttactataaccacatcataagaattctggaaaaatagagaacaaaaggaaaagattgttaccaccttgatttaataacttcttgtttccccatacatgtgttttgtttatagattgcatgggtatatgtcaatttttatatgttctgtgtttagtttacatattgtaattcatttttaagagagtacagacatacactttttgagtaggcaatatgttcacatagtttgaaattaaaggtacaaaatggcgtagaatgaaatgcctctcaccctttccccacagcgactacttcccactcagaggcaacaagtattacagttgcttgtatattcttccagagatctctgtctatacaagcaaaaacacatgtggtctttttccttgctttgcacaaatggtaaactgtacgctattctgaaccttgcttttttcagatatatgttggcaacagttccatgtcagtacatagtttcctttctttattacagctgcctgttttttcattgtgtatttgcaccatcatttacttttctggcttacttttgatagaaatctaggttggttcaaacctttttactcttaaaacaatgctgcagttaacacccttgtacatatatctttagagagaagatattttaaaaagaaatacctttttaaaaattattttattattttttaatagagactatgttgcctaggctggtcttgaaattctgggctaaagcaatcctaccaccttggcctcccaaagtgctgagattacaggcatgagccattgcacctggccaagaagagacatcttgacttgagcctgaagactatgtacagagactgacctcacagactgaccattccatcccacagctgctggacatagagtgatttgcagcccctcctttcagagtaccacatccctctcaagtgttccacaacatctaggaaagtgagctcttaaagacagactaaaaagagtaataaatcaatacaacaacattaaaagccagactagcggagtttgaatcttggccctgctgttagtaactgtgtgagccttgggcaagttactcagcctccttgtgtcttggttttggtttcttcatctctaagtaattatatctgtcattattgccctgatcacaaacaaaagcctgaatgtactatgtttaaaagacaaaccaaaaattaacccaaacttgcattatttgtctgagctacagaatgttctttccttggagagatatctgatattaaacatcatctgcattttacttgcctagaaaatacacggtaacttttctgccttgcagcatcaaactatagtacagctgagccccagtgctgtgcagtctgactctaattaaaggcaccttctttacagcagggctctggggaactggaaaagggggtttgtttcattatctggttttattaagcagatgaatgcagccagctatatgaagcactttgcagtgaatggcaggtgtcccatatctggttatgttaacctagaaagggctcactctacctctaggcatgtttcatcccaacaatcagactgtgccaaagcaggggactttgtcctttgtggattgcatagctggatacccatcatctgtttctctgattggaagctgctgttgtacagaaagacctgcatttcccccttgtctccagttctctcactactttttcctcctctgtgagtgaccatccaggcagtcaccataactgctggagtgtctgggattggtagctctctccaactgcctgcttgctctttacagcctctctctgtgactggaatctctccacctcatcgtatctaaggataacccagaaacatggggtgtcctaggtatgtttatctcgacactgaaccccctaggcttctgatgaatccagtgattagctaaatttgacatagaaagtaagaaggaatgtctactttgtattgtggtcctaatctaagatcaggagaatcctggaattgttatctgtctcttgctctgagatacagacttgttcataggtgtggggcctgattggaacaggatctgccattggtcacaataggtcaagggcttgttctgaaccctagttagcttcattcagagaaagaaacttcctacctggtcagctttttcagcttctccaacaaatgggagttgaggcagtaggagtgtggggttcttgggaagacgatggggccttgtattaaggagaaataatgaactatcttcttgattcttccattgagaaaagcatatgaatcctaggaaagggctcagcctgtgataggcattcaataaatactccaatgctgtcattcctttgtctacagcatccccaaacaatgtaccagtgatgggctacctgagctcatctagtcgccaagcagtatctcctgcttgctgctgctttactacattccagatgcccacctcatccaatttccagagccactatctctgctgtccactttccttcaggctctgtgaatacttcaacctgctgtgatttggggccgtttgtactctgcatgtattcaataaattcaattcagcaatagttatcaaatgcccattttcttactaggcactgctctaggtgtttggtatggcaatgagcaaaacacaaccattgtgagctgatgttctagaaaggtgtcaaaagcgtttcaaaggttttatgagatgctgtgggagggggttacgcactgctacctactgaggtagcaatgttgggtgtttcctcacattcctcaacctccacgcag

SEQ ID NO: 32043 - DNA, 5645 bp, Homo sapiens
ggcggccgccgtcctcttgcgcaggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgataactcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcatttgaatgtttccaaatctattttatctgacgtcatgaacacacaggcaatgattttatgacaacttgatgtgcttttttctttatttttcttttacattagaagttttctctcttttctccacctctcctttatttttaattttaattttaatttttgaaacaagatctgactctgttgcccaagctggagtacagtagtgcaatctcagctcactgcaacctccacctcccagactcaagccatcctcccacctcaacctcccaagtagctgggactacaggcatatgccatcacacccagctaatttttgtttttctgtagagacagggtttcaccatgttggccaggctggtctcaaattcctgaccttaagtgatccacctgcctaggcctctaaaatgctgggattacaggcgtgagccaccacgcccagcctataccccatgtattttcataaagggttggaaactattgattgccaactttttaaggatggtagggattttttctttgttgaatatactgtgaattttgggattctggagtccttagtcttcatttccattcttctgcccatgattactgatcaaaatactggtagagtcatggaggaagtaagttaaatgtggaaaaaatgctttaaaagtacttactataaccacatcataagaattctggaaaaatagagaacaaaaggaaaagattgttaccaccttgatttaataacttcttgtttccccatacatgtgttttgtttatagattgcatgggtatatgtcaatttttatatgttctgtgtttagtttacatattgtaattcatttttaagagagtacagacatacactttttgagtaggcaatatgttcacatagtttgaaattaaaggtacaaaatggcgtagaatgaaatgcctctcaccctttccccacagcgactacttcccactcagaggcaacaagtattacagttgcttgtatattcttccagagatctctgtctatacaagcaaaaacacatgtggtctttttccttgctttgcacaaatggtaaactgtacgctattctgaaccttgcttttttcagatatatgttggcaacagttccatgtcagtacatagtttcctttctttattacagctgcctgttttttcattgtgtatttgcaccatcatttacttttctggcttacttttgatagaaatctaggttggttcaaacctttttactcttaaaacaatgctgcagttaacacccttgtacatatatctttagagagaagatattttaaaaagaaatacctttttaaaaattattttattattttttaatagagactatgttgcctaggctggtcttgaaattctgggctaaagcaatcctaccaccttggcctcccaaagtgctgagattacaggcatgagccattgcacctggccaagaagagacatcttgacttgagcctgaagactatgtacagagactgacctcacagactgaccattccatcccacagctgctggacatagagtgatttgcagcccctcctttcagagtaccacatccctctcaagtgttccacaacatctaggaaagtgagctcttaaagacagactaaaaagagtaataaatcaatacaacaacattaaaagccagactagcggagtttgaatcttggccctgctgttagtaactgtgtgagccttgggcaagttactcagcctccttgtgtcttggttttggtttcttcatctctaagtaattatatctgtcattattgccctgatcacaaacaaaagcctgaatgtactatgtttaaaagacaaaccaaaaattaacccaaacttgcattatttgtctgagctacagaatgttctttccttggagagatatctgatattaaacatcatctgcattttacttgcctagaaaatacacggtaacttttctgccttgcagcatcaaactatagtacagctgagccccagtgctgtgcagtctgactctaattaaaggcaccttctttacagcagggctctggggaactggaaaagggggtttgtttcattatctggttttattaagcagatgaatgcagccagctatatgaagcactttgcagtgaatggcaggtgtcccatatctggttatgttaacctagaaagggctcactctacctctaggcatgtttcatcccaacaatcagactgtgccaaagcaggggactttgtcctttgtggattgcatagctggatacccatcatctgtttctctgattggaagctgctgttgtacagaaagacctgcatttcccccttgtctccagttctctcactactttttcctcctctgtgagtgaccatccaggcagtcaccataactgctggagtgtctgggattggtagctctctccaactgcctgcttgctctttacagcctctctctgtgactggaatctctccacctcatcgtatctaaggataacccagaaacatggggtgtcctaggtatgtttatctcgacactgaaccccctaggcttctgatgaatccagtgattagctaaatttgacatagaaagtaagaaggaatgtctactttgtattgtggtcctaatctaagatcaggagaatcctggaattgttatctgtctcttgctctgagatacagacttgttcataggtgtggggcctgattggaacaggatctgccattggtcacaataggtcaagggcttgttctgaaccctagttagcttcattcagagaaagaaacttcctacctggtcagctttttcagcttctccaacaaatgggagttgaggcagtaggagtgtggggttcttgggaagacgatggggccttgtattaaggagaaataatgaactatcttcttgattcttccattgagaaaagcatatgaatcctaggaaagggctcagcctgtgataggcattcaataaatactccaatgctgtcattcctttgtctacagcatccccaaacaatgtaccagtgatgggctacctgagctcatctagtcgccaagcagtatctcctgcttgctgctgctttactacattccagatgcccacctcatccaatttccagagccactatctctgctgtccactttccttcaggctctgtgaatacttcaacctgctgtgatttggggccgtttgtactctgcatgtattcaataaattcaattcagcaatagttatcaaatgcccattttcttactaggcactgctctaggtgtttggtatggcaatgagcaaaacacaaccattgtgagctgatgttctagaaaggtgtcaaaagcgtttcaaaggttttatgagatgctgtgggagggggttacgcactgctacctactgaggtagcaatgttgggtgtttcctcacattcctcaacctccacgcag

SEQ ID NO: 32044 - DNA, 4257 bp, Homo sapiens
ggtgctgcggtgatctcgaggattccgacgagttgtccgagttagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgataactcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcatttgaatgtttccaaatctattttatctgacgtcatgaacacacaggcaatgattttatgacaacttgatgtgcttttttctttatttttcttttacattagaagttttctctcttttctccacctctcctttatttttaattttaattttaatttttgaaacaagatctgactctgttgcccaagctggagtacagtagtgcaatctcagctcactgcaacctccacctcccagactcaagccatcctcccacctcaacctcccaagtagctgggactacaggcatatgccatcacacccagctaatttttgtttttctgtagagacagggtttcaccatgttggccaggctggtctcaaattcctgaccttaagtgatccacctgcctaggcctctaaaatgctgggattacaggcgtgagccaccacgcccagcctataccccatgtattttcataaagggttggaaactattgattgccaactttttaaggatggtagggattttttctttgttgaatatactgtgaattttgggattctggagtccttagtcttcatttccattcttctgcccatgattactgatcaaaatactggtagagtcatggaggaagtaagttaaatgtggaaaaaatgctttaaaagtacttactataaccacatcataagaattctggaaaaatagagaacaaaaggaaaagattgttaccaccttgatttaataacttcttgtttccccatacatgtgttttgtttatagattgcatgggtatatgtcaatttttatatgttctgtgtttagtttacatattgtaattcatttttaagagagtacagacatacactttttgagtaggcaatatgttcacatagtttgaaattaaaggtacaaaatggcgtagaatgaaatgcctctcaccctttccccacagcgactacttcccactcagaggcaacaagtattacagttgcttgtatattcttccagagatctctgtctatacaagcaaaaacacatgtggtctttttccttgctttgcacaaatggtaaactgtacgctattctgaaccttgcttttttcagatatatgttggcaacagttccatgtcagtacatagtttcctttctttattacagctgcctgttttttcattgtgtatttgcaccatcatttacttttctggcttacttttgatagaaatctaggttggttcaaacctttttactcttaaaacaatgctgcagttaacacccttgtacatatatctttagagagaagatattttaaaaagaaatacctttttaaaaattattttattattttttaatagagactatgttgcctaggctggtcttgaaattctgggctaaagcaatcctaccaccttggcctcccaaagtgctgagattacaggcatgagccattgcacctggccaagaagagacatcttgacttgagcctgaagactatgtacagagactgacctcacagactgaccattccatcccacagctgctggacatagagtgatttgcagcccctcctttcagagtaccacatccctctcaagtgttccacaacatctaggaaagtgagctcttaaagacagactaaaaagagtaataaatcaatacaacaacattaaaagccagactagcggagtttgaatcttggccctgctgttagtaactgtgtgagccttgggcaagttactcagcctccttgtgtcttggttttggtttcttcatctctaagtaattatatctgtcattattgccctgatcacaaacaaaagcctgaatgtactatgtttaaaagacaaaccaaaaattaacccaaacttgcattatttgtctgagctacagaatgttctttccttggagagatatctgatattaaacatcatctgcattttacttgcctagaaaatacacggtaacttttctgccttgcagcatcaaactatagtacagctgagccccagtgctgtgcagtctgactctaattaaaggcaccttctttacagcagggctctggggaactggaaaagggggtttgtttcattatctggttttattaagcagatgaatgcagccagctatatgaagcactttgcagtgaatggcaggtgtcccatatctggttatgttaacctagaaagggctcactctacctctaggcatgtttcatcccaacaatcagactgtgccaaagcaggggactttgtcctttgtggattgcatagctggatacccatcatctgtttctctgattggaagctgctgttgtacagaaagacctgcatttcccccttgtctccagttctctcactactttttcctcctctgtgagtgaccatccaggcagtcaccataactgctggagtgtctgggattggtagctctctccaactgcctgcttgctctttacagcctctctctgtgactggaatctctccacctcatcgtatctaaggataacccagaaacatggggtgtcctaggtatgtttatctcgacactgaaccccctaggcttctgatgaatccagtgattagctaaatttgacatagaaagtaagaaggaatgtctactttgtattgtggtcctaatctaagatcaggagaatcctggaattgttatctgtctcttgctctgagatacagacttgttcataggtgtggggcctgattggaacaggatctgccattggtcacaataggtcaagggcttgttctgaaccctagttagcttcattcagagaaagaaacttcctacctggtcagctttttcagcttctccaacaaatgggagttgaggcagtaggagtgtggggttcttgggaagacgatggggccttgtattaaggagaaataatgaactatcttcttgattcttccattgagaaaagcatatgaatcctaggaaagggctcagcctgtgataggcattcaataaatactccaatgctgtcattcctttgtctacagcatccccaaacaatgtaccagtgatgggctacctgagctcatctagtcgccaagcagtatctcctgcttgctgctgctttactacattccagatgcccacctcatccaatttccagagccactatctctgctgtccactttccttcaggctctgtgaatacttcaacctgctgtgatttggggccgtttgtactctgcatgtattcaataaattcaattcagcaatagttatcaaatgcccattttcttactaggcactgctctaggtgtttggtatggcaatgagcaaaacacaaccattgtgagctgatgttctagaaaggtgtcaaaagcgtttcaaaggttttatgagatgctgtgggagggggttacgcactgctacctactgaggtagcaatgttgggtgtttcctcacattcctcaacctccacgcag

SEQ ID NO: 32045 - DNA, 4828 bp, Homo sapiens
ctgcctattcctgtatataattcattcctttctttaacatctttaacagatatattgagggccagatttgtgctaggcactgttctagatgctgagaatgtaaaaagtgaaaatctaagttagatgtaattaatgctatggagaaaaatcaagcaagaaggggagaaggggtgatggtgaaagccttggcaattcttgatagggtaatcaaggaaggcacctctgagcaggaactatttgagggaagctctgaaggaggtggccatgctgccatgtagggaaagagggaatggtaagggggagcatgctggtatgtgggaggggcagcaaggaggctagtgctggggagtggagtgagcgctggggagtgggtaggagaggaagcttgagcaagacgcagattttgtagggccttgtaggcctttgaaaggactttgactttaactcactgtgagaggaatgaggagtgggctttgagcagagagtgacatgatctgacttctgttttctcagttcgctatggctgctgtgtgaggaagagacagggtggcgaggctggaagcagggagtccacggaagggaaatacaggctcctcatttatttatttctcttctttttctccaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgataactcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcatttgaatgtttccaaatctattttatctgacgtcatgaacacacaggcaatgattttatgacaacttgatgtgcttttttctttatttttcttttacattagaagttttctctcttttctccacctctcctttatttttaattttaattttaatttttgaaacaagatctgactctgttgcccaagctggagtacagtagtgcaatctcagctcactgcaacctccacctcccagactcaagccatcctcccacctcaacctcccaagtagctgggactacaggcatatgccatcacacccagctaatttttgtttttctgtagagacagggtttcaccatgttggccaggctggtctcaaattcctgaccttaagtgatccacctgcctaggcctctaaaatgctgggattacaggcgtgagccaccacgcccagcctataccccatgtattttcataaagggttggaaactattgattgccaactttttaaggatggtagggattttttctttgttgaatatactgtgaattttgggattctggagtccttagtcttcatttccattcttctgcccatgattactgatcaaaatactggtagagtcatggaggaagtaagttaaatgtggaaaaaatgctttaaaagtacttactataaccacatcataagaattctggaaaaatagagaacaaaaggaaaagattgttaccaccttgatttaataacttcttgtttccccatacatgtgttttgtttatagattgcatgggtatatgtcaatttttatatgttctgtgtttagtttacatattgtaattcatttttaagagagtacagacatacactttttgagtaggcaatatgttcacatagtttgaaattaaaggtacaaaatggcgtagaatgaaatgcctctcaccctttccccacagcgactacttcccactcagaggcaacaagtattacagttgcttgtatattcttccagagatctctgtctatacaagcaaaaacacatgtggtctttttccttgctttgcacaaatggtaaactgtacgctattctgaaccttgcttttttcagatatatgttggcaacagttccatgtcagtacatagtttcctttctttattacagctgcctgttttttcattgtgtatttgcaccatcatttacttttctggcttacttttgatagaaatctaggttggttcaaacctttttactcttaaaacaatgctgcagttaacacccttgtacatatatctttagagagaagatattttaaaaagaaatacctttttaaaaattattttattattttttaatagagactatgttgcctaggctggtcttgaaattctgggctaaagcaatcctaccaccttggcctcccaaagtgctgagattacaggcatgagccattgcacctggccaagaagagacatcttgacttgagcctgaagactatgtacagagactgacctcacagactgaccattccatcccacagctgctggacatagagtgatttgcagcccctcctttcagagtaccacatccctctcaagtgttccacaacatctaggaaagtgagctcttaaagacagactaaaaagagtaataaatcaatacaacaacattaaaagccagactagcggagtttgaatcttggccctgctgttagtaactgtgtgagccttgggcaagttactcagcctccttgtgtcttggttttggtttcttcatctctaagtaattatatctgtcattattgccctgatcacaaacaaaagcctgaatgtactatgtttaaaagacaaaccaaaaattaacccaaacttgcattatttgtctgagctacagaatgttctttccttggagagatatctgatattaaacatcatctgcattttacttgcctagaaaatacacggtaacttttctgccttgcagcatcaaactatagtacagctgagccccagtgctgtgcagtctgactctaattaaaggcaccttctttacagcagggctctggggaactggaaaagggggtttgtttcattatctggttttattaagcagatgaatgcagccagctatatgaagcactttgcagtgaatggcaggtgtcccatatctggttatgttaacctagaaagggctcactctacctctaggcatgtttcatcccaacaatcagactgtgccaaagcaggggactttgtcctttgtggattgcatagctggatacccatcatctgtttctctgattggaagctgctgttgtacagaaagacctgcatttcccccttgtctccagttctctcactactttttcctcctctgtgagtgaccatccaggcagtcaccataactgctggagtgtctgggattggtagctctctccaactgcctgcttgctctttacagcctctctctgtgactggaatctctccacctcatcgtatctaaggataacccagaaacatggggtgtcctaggtatgtttatctcgacactgaaccccctaggcttctgatgaatccagtgattagctaaatttgacatagaaagtaagaaggaatgtctactttgtattgtggtcctaatctaagatcaggagaatcctggaattgttatctgtctcttgctctgagatacagacttgttcataggtgtggggcctgattggaacaggatctgccattggtcacaataggtcaagggcttgttctgaaccctagttagcttcattcagagaaagaaacttcctacctggtcagctttttcagcttctccaacaaatgggagttgaggcagtaggagtgtggggttcttgggaagacgatggggccttgtattaaggagaaataatgaactatcttcttgattcttccattgagaaaagcatatgaatcctaggaaagggctcagcctgtgataggcattcaataaatactccaatgctgtcattcctttgtctacagcatccccaaacaatgtaccagtgatgggctacctgagctcatctagtcgccaagcagtatctcctgcttgctgctgctttactacattccagatgcccacctcatccaatttccagagccactatctctgctgtccactttccttcaggctctgtgaatacttcaacctgctgtgatttggggccgtttgtactctgcatgtattcaataaattcaattcagcaatagttatcaaatgcccattttcttactaggcactgctctaggtgtttggtatggcaatgagcaaaacacaaccattgtgagctgatgttctagaaaggtgtcaaaagcgtttcaaaggttttatgagatgctgtgggagggggttacgcactgctacctactgaggtagcaatgttgggtgtttcctcacattcctcaacctccacgcag

SEQ ID NO: 32046 - DNA, 383 bp, Homo sapiens
tttttttgagatggagtcttgctctgtcgcccaggctggtgtgcagtggcacaatcttggctcaccgcaacctctgccccctgggttcaagcaattctcctgcctcagcctcccaagtagctgggactacaggtaccgactaccacacctcgctaatttttgtatttttagtagagacggggtttcaccatgttggtcaggctggtctcgaattcctgacctcaagcaacctgcccacctcggcttcccaaaatgctgggattacaggcgtgagccactgggcctggccgtgatttgtgattctttccttcaaaacctagcagtgtttttattgaggccaggaatgtgtatttctagattaagaaattaatacacaggaataa

SEQ ID NO: 32047 - DNA, 421 bp, Homo sapiens
ggaagcgggtccctgggtggcggaggttattgggggagggctagaggctcccctgagatcaggaagccctggaccccattgcacagatgtatagtgcagtggttagaaaccagaatctaggactgactaacctgggtgtgaattctggctccaccacttagcttgtgacctcggacaagttacttaacctctctgtgctatagtttcagggcctataaaatggtaacaatggtacgtaccagccgggcacggtggcttacgcctgtaatcccagcactttgggaggccgaggtgggcgaatcgcctgaggtcgggagttcgagaccagcctggccagtatggtgaaaccccatctctattaaaaatataaaaattagccgggcatagtggcaggcgcctgtaatcccagctactcgggaag

SEQ ID NO: 32048 - DNA, 339 bp, Homo sapiens
taagacaggatcttgctctgtcgcccaggctgcagtgcagtggtgcgatcaaggcccactgtaacttcaaactcttgggctcaaactcctggctaatgtttgttaggtttttttttttctccctgtagagacagggtctttctatgttgcccaggctcgtcttaaactccaggcctcaagttatcctcccacctcagcctcccgaattgctgagattatagatgtgagcccccatgcctggccagtaatcactcacattttaaaaagctcacagaaatgtggatatagaattttcagtttactgtatattccaaattatctacaatatgcatgagaatc

SEQ ID NO: 32049 - DNA, 1650 bp, Homo sapiens
aaaatctcagctgggcatgggcatggtagtgcatgcctgtaatcccagctactccagaggctgaggcatgagaatcccttgagccagggatgcagaggttgcagtgaactgagattgtgccactgcatccagcctgggtaacagagtgagactcggtctcaagagaaaaggaattttcttattttaaaaataatattctgttgtgtatatctaccacattgtcttcatttactcattagatgttaaactgtttattctgtattttggctattgtgaaaagtgctacaaacagaattgcaaatgtttcttcattctgattttatttgttttggatatatatccagtagtgcaattgctgttatgacatggtagtttaagttttttgagaaatctctattttgtttttcataatggctgtcttcatttacattccaaaccaacagtgtgcaagccttcccttttcttcacatctttaccaacgctttttctttttaataagagtcattctaacaggaatgagttgatatctcctagttttgttttttcttttttggcttgcctttttgtgataattgacattgagcatttttaaatatatcagttggccattatgtatgtattttcttgaaaaatacttatttcagctacttatttttaatagttacttatttttgttgtattgtcatttgagttttgtatatatttttgatattaaccccttgtcacatgtataatttgcaaatattttctccctttttttagttgtcacattctgttcattgtatcagattctgtgcagcagctttttaatttgaagtgatctgactgacttgttcttccttttgtgtcctgggatatttaggttaaatcaaaaaacttgctgcccagaccaatgttatggggctttcactctattttttggtagtagtagtttaagagttttaggccttacatttaagtggctaatttattttgagtttatttttacatatggtgtgagatgagggtctcacttttttttctctgcatgtggacataaagttttctaaacatcatttattgaagatactgttatttcccttaaaaaaaaaagtcacctgtatttaaaatcagttagctgtaaatacactgatatatttctgctctctttttcttctgctccattggcctatatctctgtttttattcaagtgacatactgttttggttaccacagttttgtagtgtatttcaaagtcagggtgataccttcttttgtcttgattgctttggctatttagggtgttttgtggtaccatatgaattttagatatgctttttaaaaatgtctatgaagtatgtcactggtattttgatagaggttgcattatatctgcagatcattttgtgtaatacaaatatttaactattaaaaatgccagttcatgaatgagtaatattattccatttatgtgttacttaatttgtataatgttctttagagtagaatgtaaggtgtttcaactttttggttaaatttacttcaaactatagttaggtagatggaatttttttgaatttcattttgagatagttactaatgtatagaaatgctatgactttttgatgatgtttttgtattttgaaagtttaataaattttgtttgttta

SEQ ID NO: 32050 - DNA, 2199 bp, Homo sapiens
aaaatctcagctgggcatgggcatggtagtgcatgcctgtaatcccagctactccagaggctgaggcatgagaatcccttgagccagggatgcagaggttgcagtgaactgagattgtgccactgcatccagcctgggtaacagagtgagactcggtctcaagagaaaaggaattttcttattttaaaaataatattctgttgtgtatatctaccacattgtcttcatttactcattagatgttaaactgtttattctgtattttggctattgtgaaaagtgctacaaacagaattgcaaatgtttcttcattctgattttatttgttttggatatatatccagtagtgcaattgctgttatgacatggtagtttaagttttttgagaaatctctattttgtttttcataatggctgtcttcatttacattccaaaccaacagtgtgcaagccttcccttttcttcacatctttaccaacgctttttctttttaataagagtcattctaacaggaatgagttgatatctcctagttttgttttttcttttttggcttgcctttttgtgataattgacattgagcatttttaaatatatcagttggccattatgtatgtattttcttgaaaaatacttatttcagctacttatttttaatagttacttatttttgttgtattgtcatttgagttttgtatatatttttgatattaaccccttgtcacatgtataatttgcaaatattttctccctttttttagttgtcacattctgttcattgtatcagattctgtgcagcagctttttaatttgaagtgatctgactgacttgttcttccttttgtgtcctgggatatttaggttaaatcaaaaaacttgctgcccagaccaatgttatggggctttcactctattttttggtagtagtagtttaagagttttaggccttacatttaagtggctaatttattttgagtttatttttacatatggtgtgagatgagggtctcacttttttttctctgcatgtggacataaagttttctaaacatcatttattgaagatactgttatttcccttaaaaaaaaaagtcacctgtatttaaaatcagttagctgtaaatacactgatatatttctgctctctttttcttctgctccattggcctatatctctgtttttattcaagtgacatactgttttggttaccacagttttgtagtgtatttcaaagtcagggtgataccttcttttgtcttgattgctttggctatttagggtgttttgtggtaccatatgaattttagatatgctttttaaaaatgtctatgaagtatgtcactggtattttgatagaggttgcattatatctgcagatcattttgtgtaatacaaatatttaactattaaaaatgccagttcatgaatgagtaatattattccatttatgtgttacttaatttgtataatgttctttagagtagaatgtaaggtgtttcaactttttggttaaatttacttcaaactatagttaggtagatggaatttttttgaatttcattttgagatagttactaatgtatagaaatgctatgactttttgatgatgtttttgtattttgaaagtttaataaattttgtttgtttaaaaaaaaaaaaaaaaaactcgagactagctcgtgccgaattcggcacgaggatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggtgtaaaaacaaagaccgggacaaggaacgggaaaaggaccgggaaaaagacaaggaaaaggacagagagagagaacgggaaaaagagcatgagaaggatcgagacacagagaaggaaagggaccggacaaggacaggaacgagaaatagacagatccaagagatagatgaaaaagaaagatgata

SEQ ID NO: 32051 - DNA, 298 bp, Homo sapiens
agcaagaccttgtttctaaataaataaacaaacaaataaatctttgttttggctggtcatggtgattcatgcctgtaatcccagcgctttgggaggccaaggtgggtggatcacttgaggtcaggagtttgagaccagcctggttaacaaggcaaaaccccgtctctactaaaaatacaaaaaaaattagccggatgtagtggtgggtgcctgtaatcccagctacttgggaggcagaggttgcagtgaaccaagatcatgcaccccagcctgggcaacagagtgagactacatctca

SEQ ID NO: 32052 - DNA, 153 bp, Homo sapiens
taaacattcaagaaatagctatttcatgaatgaattgaatttaaaattttattttataattgaaacatcaaaaacctatcacataagcatttgtttctcccattgatatcattgatatgtcttgctctcttggcattctgtctttcccatctt

SEQ ID NO: 32053 - DNA, 479 bp, Homo sapiens
tttttttttgtgtgaaacaaatagtttttgggcactatgaaccatgcccatgtaagacagcaaacttaatggtatatgttctcactgctccaccaacactgttctcttttctctctccctctcctggggactttctattccctaagacacaacaacactgaaattaggccaaatagtaaccctaaaatgacctcaagtgctcaagtgaaaggaatagtcacaagtctctaattatggacatgattaagtttagtgagaaaggcatgtctaaatctgacataggacaaaagtgaggcctcttgcaccaaacagttaggcaagttgtgaatggaaaggagaagttcatgaaggaaattagaaatgctacttcagtgaacacatgaatgataagaaagcaaaacagccttactggtgatatggagaaagttttggtggtttggttagatcaaactagccacaatattctgttaggccaaagc

SEQ ID NO: 32054 - DNA, 2371 bp, Homo sapiens
aggtataacagaataagtatctgtttatctaatctacatgtgactatcttagtctctctcggtcacttaatattatgctgaaatttaccactgtggggatgaatgatcgctattcaccaagtatatttgaacatgtaaatgcttaagaaataagcataatgcggatatagtttgggttaataggattctcatagttttttttcccctatgaaacataagtaatgattttagtgtatttcttatggaatacactcatttaaaaaggactttaagaaattgtggatgtgaataatacctttctctaataaaaatttaaattgtataatagttttataatatttacattaattgatattttaatatggatagacattgcatagattcaaataaattaaaatcaatgataaatgctaaatattttatctaaatagtttttcaagaaacagttatggaaatgtgtatattaaatggctctaatgtggagcttgtggtatttcaactcagtattcattattagttgtgtgtctggaaagattgtacttacttttcctctttacactacagtttgctcttatggggctctaaactgtttaactgaagaaccttcgtctgtatttgattgagcataatttagtattttatgatttccaagatgatgttcttatgtctatcaagtctatgtatcaaatttataacatcatttaagaaaaaggaatttccacagatacttcagttgcaattttttgtttcatgctactgaaaatacatttgtttctaggggttggaatattatagaagatgtaggatgaaagaaaacgatagaacaacgaaagaattctgtttatgaaattacaggaattgtgtccactatggtaaagcattgtcattttagtacattttctcttagtagtttggcattttatactttaaaacttgttttgctttaaaaattgtttataatgcttaccttctttctccagtgcctttagtcttgatttgatatgtttgtaccctcagttaccctttctattacatgtttttgatgttttcatagcctaggaaacatcgattcctttttaataattgtcaatctgattatttaaagaggtaacaattatctgttaatgctttggaaaaacaagtagggttgccttggaggccaggcttcttagttcattcaaaaatattccttggatttatgccatgtattaagcatttttagcccccagtattacaactgtgaaccaaacggataaggccctaaccattttcagcattctctttggatggggtgggattggggacttaattaaaatagagatatagaaaaataggcatctaaataagataataagtgtggggttgaaatgaagcatctaacaatagttgaagttagaagtaatattttacagtattgtaacctctatttaagtttgggtattagttacagatagcataaaaaagccttaatttttcactttccttgctggcaaaggtacatttatttagactgtccatttaaagtaatgtttaacataaacattactgtgaaaaacattccattacatattcccaagcaaatgagctgcatcttctttactgtattttacaatttagtacaacagttttaggcctcaatcttaacatcactggtattttaaatttgggcaatgaatatgaaattacttttgacttacagattgattatattattactttgaaaatgcattaatttcttagaaaagtttggagcctctatctttttttgagttaatacttaaattctcattacttatattaatagcctgtactaagtgaaaatattatttatgcaagtaaacaagtcactataggcttttaagacttttctttaattttagattttgtcatcaaagtttaaattttttacctactgtccacttaaatataatttaacagtttgtaaagtgaaatagttttaagtatgatgtatgatgcacctggcatataaatgaaaatgggcgtgcacaaagacactttactatgggaactgtactggaagatttatgaaagcatgtgaaattgcacctaaaattgtgttattagtgactataagcagcaatgctaaatttattgtacttgatgaatgaatgtatttagtcacagttactttggtttaaatgtataaatgtctttagggtttttttttaaatgtgtttgtaatttgtactattgtgggggtatacttggactgcaggggttattgtcaatgtgtgatttgtgtttttattttatagaatcatctaatgtgatataccaatttttataagtgatatttacataattctaataactgtatatttgacaacctattaaaatgttttgcattgga

SEQ ID NO: 32055 - DNA, 2531 bp, Homo sapiens
aggtataacagaataagtatctgtttatctaatctacatgtgactatcttagtctctctcggtcacttaatattatgctgaaatttaccactgtggggatgaatgatcgctattcaccaagtatatttgaacatgtaaatgcttaagaaataagcataatgcggatatagtttgggttaataggattctcatagttttttttcccctatgaaacataagtaatgattttagtgtatttcttatggaatacactcatttaaaaaggactttaagaaattgtggatgtgaataatacctttctctaataaaaatttaaattgtataatagttttataatatttacattaattgatattttaatatggatagacattgcatagattcaaataaattaaaatcaatgataaatgctaaatattttatctaaatagtttttcaagaaacagttatggaaatgtgtatattaaatggctctaatgtggagcttgtggtatttcaactcagtattcattattagttgtgtgtctggaaagattgtacttacttttcctctttacactacagtttgctcttatggggctctaaactgtttaactgaagaaccttcgtctgtatttgattgagcataatttagtattttatgatttccaagatgatgttcttatgtctatcaagtctatgtatcaaatttataacatcatttaagaaaaaggaatttccacagatacttcagttgcaattttttgtttcatgctactgaaaatacatttgtttctaggggttggaatattatagaagatgtaggatgaaagaaaacgatagaacaacgaaagaattctgtttatgaaattacaggaattgtgtccactatggtaaagcattgtcattttagtacattttctcttagtagtttggcattttatactttaaaacttgttttgctttaaaaattgtttataatgcttaccttctttctccagtgcctttagtcttgatttgatatgtttgtaccctcagttaccctttctattacatgtttttgatgttttcatagcctaggaaacatcgattcctttttaataattgtcaatctgattatttaaagaggtaacaattatctgttaatgctttggaaaaacaagtagggttgccttggaggccaggcttcttagttcattcaaaaatattccttggatttatgccatgtattaagcatttttagcccccagtattacaactgtgaaccaaacggataaggccctaaccattttcagcattctctttggatggggtgggattggggacttaattaaaatagagatatagaaaaataggcatctaaataagataataagtgtggggttgaaatgaagcatctaacaatagttgaagttagaagtaatattttacagtattgtaacctctatttaagtttgggtattagttacagatagcataaaaaagccttaatttttcactttccttgctggcaaaggtacatttatttagactgtccatttaaagtaatgtttaacataaacattactgtgaaaaacattccattacatattcccaagcaaatgagctgcatcttctttactgtattttacaatttagtacaacagttttaggcctcaatcttaacatcactggtattttaaatttgggcaatgaatatgaaattacttttgacttacagattgattatattattactttgaaaatgcattaatttcttagaaaagtttggagcctctatctttttttgagttaatacttaaattctcattacttatattaatagcctgtactaagtgaaaatattatttatgcaagtaaacaagtcactataggcttttaagacttttctttaattttagattttgtcatcaaagtttaaattttttacctactgtccacttaaatataatttaacagtttgtaaagtgaaatagttttaagtatgatgtatgatgcacctggcatataaatgaaaatgggcgtgcacaaagacactttactatgggaactgtactggaagatttatgaaagcatgtgaaattgcacctaaaattgtgttattagtgactataagcagcaatgctaaatttattgtacttgatgaatgaatgtatttagtcacagttactttggtttaaatgtataaatgtctttagggtttttttttaaatgtgtttgtaatttgtactattgtgggggtatacttggactgcaggggttattgtcaatgtgtgatttgtgtttttattttatagaatcatctaatgtgatataccaatttttataagtgatatttacataattctaataactgtatatttgacaacctattaaaatgttttgcattggaacttttttcattaattgtaacatgctaacgtggtttaaaaataactcattcattcaacagatattgaatgttgtgtatcagaaactataggaatcactggggaatcaaagatgacaaagtgcatcagtggaaagatccatgctctcagacaaattgggga

SEQ ID NO: 32056 - DNA, 503 bp, Homo sapiens
gtactgggattcagatgtgagccagtgcacccggccacaaacttagtcttaaaaacaacacaaattgactgtctgtggttgtgtatctgcaggtcacaatctagcagggctctctcggagctgaaatggcagtggcagggctgcattcccatctggaggctccagggagaagacttgccttgcactttacactctcctgggcttgcagccccttccccacctccaaagcagcaatgctgggctgagtccatatgctgtcgcccacccctgaacacttctgcctcctcttctactttcaaaaacacttgggaatacactggactcacccacacgatccaggacaatctcccccttcagatcctctccttacatctgcaaagcccccttcacctgggaaggccacactcacctacttctgcggggtcctgcgtggacactctgaagtcacgtctcagattgttggtctgcacctccatgctttttctctgtctctttttcccttt

SEQ ID NO: 32057 - DNA, 451 bp, Homo sapiens
gagacaataattatataccagtggttgccacttaactgcacaaatagtcatttgtattgtcaatcttaggtgggccgaattttgtttctccttgtctctggacttcctccagtgtaggtcccatttgcctctgattgtggggcaatttcattttaagaatggcctttcaggccaggtgtggtggctcatgcctgcaatcctagcactttgggaggccgaggtgggtggatcacctgaggtcaagcgttcaagaccagtctggccaacatggcaaaaacccatctctactaaaaatacaaaaattagccaggtctggtggtgcatgcctgtagtcccagctactcgggaggctgaggcaggagaatggcatgaacctgggagacgacagttgcagtgagccaagattgcgccgttgcaccccagcctgggcgacagagcgagactctgtctc

SEQ ID NO: 32058 - DNA, 1578 bp, Homo sapiens
  misc_feature (1033)..(1033): n is a, c, g, or t
cacccacacccattcactgatgcctcgccagcttccatgccacctgtcagcactgagtaattaggagaccgcatggcccacaaagctgcttgtgtggcccgttatgggaaaaaaaaaaaaaaggctaactcctgaattgcacaaatcttgatggatagaggggagaaaagcaaggcaggtccacacccccattaagaaaaggacaccaactgtagcttgaaggatctgaggggtctactccagatatcgcagagtgggagtggagaaaaaacagtagatgtgctgaaatgcttccggggcccttgaaaaagagatgggaagatgacaactttggtctcagcagagaacagcaaggaattggccaacaagagaacatagatgtttcggtcaagctagtcctttgggtgagataagttggaaaaaaaggtgtttctgccacttgaagtgtttggtacaggtttcacatctttgtgagatgacatacatgagttcttgagagacattcagaaagtgtaaattgatatgccagctaaagctcccaaaatgaagagagtgctggtccagtatagtctcttgttcagaacgatgatctcctgtgactttagagtttgtgctctgtatgttataaagatctttactaccaaagccttttcttgtgagaaattagggctctgtgtctttattagtaggacatgtgccatctcctcatagttatgttcactgtggttttctcaaaaacaaagccaagcataccttgatcagtgagatttgccattcaaaaaccagagagatgttcatacatgcataattgcatctttagcttttctatctccggcccccagagctgctttggggagttttattcttctagtttgagcagacacttctgtcatttcatttaaagtaaatgccacaatttacaagcccagcatcagttctcctccttggggatactgacagagaggaaatgggggctctttggtcctttccaagcacagcctcaaatgctatattttgaaaatagaaaatacanaaaaatgacatggtaccaagtcagcaaacaatgcatagggaaattttgggtaaggcagaattgtgggagttagtgttggacacttgggttgtctgcgacctgtttacaaaaggtcataggtggttttcttggggtcattgcaaatagtcaactgaacaattcacatcagtccttgtggattacatttactgtactaaaaggatcaaaaagagaaatggggaaaaaagatgaggacacaaggacagacttctaaaacttagtcaggtggaagccccaggatcagtccatgtttggttaatgcctttctggaatttgcaaccaaattatttatatttgaaaatgtagtagagattgctaaacatttaaatataaggtataagacttcaatgttaactgttagagctaacttattgacagactggattctaccaagcaatgactgttatataaacttttccttaaaagttaaatatatggcatggctaaaatctacagaattgtgtagataaaaaaatatactttgaatacatatcagccacaattca

SEQ ID NO: 32059 - DNA, 258 bp, Homo sapiens
cgaacccaaatcactggcccaagttccaccccttgccccagacctccagtccccttcagcaccatgggtgcagcccctaccagcagctagcagaagggctgcccggaatctctagtcctccctggaatcaaatccaggtccctcttactgccacagctccacacttgatcccaggcctcctggtggtcaaacccagacccttcttgctatagtagtttgtcaccccctgctattaaactgccattgacttttagtctc

SEQ ID NO: 32060 - DNA, 696 bp, Homo sapiens
cttagggtcagctttatgattcgttcttctgctgtcatcctttttcatcctattcacagcctgtaccggtgagggaatttgtctcaaaagcattcagcccttcaaagatttttattgtggtgaactcagaactgataaacagaaaaacagaaacagaaaaagggaactgatatgggggcgatcttgatgcgggttgtgtctctcatgcatgataactcagaggacaggctcctcggtagtgcggtagtgctaactctgtgaagtttcttcaccctccttcctagccctggaggcggggtgattcatagctcctgttccaaaggcattcagcagccattcgacctgggaaagaaacagagttttagaaaatacaggccaaatgtagagacgcctgtgattaccaggatgagtatgtcagtgcaggtggcttctgaatttctgtttctgagtttgtttggctgatgcctaaggaaaggggtcccttacagccctgttttataccttagttcttggtggcaacgtgggtgttgctgatctctctgatgtgtttttctgtgcactgaaaacaccagacatgctccgtgacatcctcggagcatctcccatcataatggagtgttcctaacctgacaaagaatagcatattacctccccatctactcaaaataaaattatagtaaaatttatcgcccttct

SEQ ID NO: 32061 - DNA, 760 bp, Homo sapiens
taatatgaagcatatattttactttagagctttaaaatgatttaaagtaacaattttagtaacctttgggtttgtcttgaaagtattttcatttcatttgtttctaaaatacttgtttctctgaagagagaagatggctcaatctgatgacatacgtaaccgtgatgactgacagtttaaactgaaatcaataaagggagaatagtttttaaatgcattgagacaaagcatacaggaaagatataattttgtataatcttttgttgaagtcttcaaaacagtacaagtgttatttgcctcatgacatgaaaattcacagtaaacaaagctattatatttgaatttcacaaaaatgtttactttcttagttatccttcagaaaaaaattcagaatgatgactcttctcaaattaagtatttatactaatacctgcaaaaactgtcatttagggattatttgtacagttctatgtggtaacactcagccatgcaacatgtgcatatattagtttccatatgtaaaatctggaattactgaaacaatctgtcttagactttttttgatgaagaattagattaaaaactccttatttataacaacatggtagtcattgaatgtaagaactcagatcacattgcagatattctaaaaatagaatgtaaattaggttttaacactaattctgagattattatatgtggcaaataatttgaatgatattcagcagtctaatttaggtaatcaaatcacagagattta

SEQ ID NO: 32062 - DNA, 426 bp, Homo sapiens
tgtcctttgtcagattgaggaagtttcctaatattcctagattgctgagaatttttgtcatgaataggtattgcatttgtcaaatgcttttctgcatctgttgaaatttctcattatggcctttcccctttagtctattaatttgatgaattacattggttcccagtattaagccaatcttgcctcctggggataaactctacttggtcctgatatgttatctttttaatgtattgttggcagcttgggcaacacagcaagactctgtctctacagaaaatttaaaaattagccaggcatagtggtgcatggttctatcccagcttctttggaagttgaggtaggaggattgcttgagccccagagttgaaggttacaatgagctataattatgccactgcactccagcctgggtgagagagtgag

SEQ ID NO: 32063 - DNA, 541 bp, Homo sapiens
cagatttattgggttccacaaatagaaatctatggaaattttgaatcaaattgcattaagctatagacaaggttgagacaaattgacatctccagaatattgagttttccaaaatatgtaagtggagtacccatttatttagattatctttcatttatatccgcaatgatttatagtattctgtgtttacatattatgcatcgtttgttagattcctgggtaagtgactttattgtaagtttcattgttgttaatctatagcaatcattctccaagtgtggtcccctgatgaggagcatcagcatcaccagagagaactggttaaaaatgcaaattcttaatttttaatttttgtgagtacatagtagatatatatatggggtacatggaatattttgatacaggcatataacatgtaattatcgcatcagggtaattggggtatccattacctcaagcatttatcctttgtattagaaacaatccagttatactcttttagttattttaagatctataattaaattatcgactatagtta

SEQ ID NO: 32064 - DNA, 443 bp, Homo sapiens
ggagatgggaagtgggatgcaagctcaaagcgggaagtcgcctgagggctgtaggaatcaagaaatgcttccagaagttactttggtggagagggttctggtagatgggcagaagtgaacacctgcagggagccaagagtgggatcgtggatccctcaagaagagaaattgggaaggagacagaaccaggtggcggaaagcaagagaacaaacaagcaaggtggtttcatgggagagtcacttaagaagaaaatgctggggagaaacaaggaggaattcaaagatgaggttggagaaggtgctgaaaaaaaagaaaggagctgaacatggtggctcaggcctataattccagcactttgagaggccaaggcaggcagatcacttgaggccaggagttcaagactagtgtggccaacatggagaaagcccgtctctacccaaaa

SEQ ID NO: 32065 - DNA, 725 bp, Homo sapiens
tcttgacaccaggcatgtctgcaaatttcaggacaacagtgaccaatggttaagatggtgactaagtgtaatcagaaaaaaatctttaactccaagtttagactagccagtttgtttaattggatttctctggtcaaaacctaaactattggtgctttctaacctgtggggatcagtgtgcatagaccattttgccctcgatttcagcataacatagtaaaaagactgggttttagattcaaaagtcatgggtttgtgatacagtgtacttactgattatgtgacgtcagttacttctctgaacctctttccttctctataaaatcataatgcttcactggattaatgaaataagatatttgtgaaaagaactctgtaaattataaaaagttaaaaacttttacatatagcacattatgtgactagtaagtactgctgtgtcttactagcgcaattttctgtggcagcattgacacgtatctcctaaaaatataaagttccccacgtttacaagcagcatgataggttcaggaagaggaggtagatgagaggtaacatcttattatttatgtaattatgggctccataagtttattttttaagcaccatatatgtgtgtgtttcaaaataaacataaggcatcatatatttaaacatatataaccataatgcttgtatttataaatcattttccaagaaagaataaatcaaaatttgaaattctg

SEQ ID NO: 32066 - DNA, 86 bp, Homo sapiens
ccaaggaaaaaaataaaaacaaacggaaaaattattacatagaacaaaataaagataaggatgatcacagatttcttttcagaaac

SEQ ID NO: 32067 - DNA, 853 bp, Homo sapiens
aactggagttattttcatcagcacactgttgccccagtctcacagtgatgcagtattaccccccaagtacctacctctcatgactgccagagagaaaagagccctcataggacaaaaaaaaaaaagcccatgacagggctgtcctgtgctaacgatgtatacaactattgctaaatcctcactcccttcctccttttgctgcctgtccccacccagagggtgtgttgccacttataactgctcaggcaggctggccctggccttgggagctcagagtcacaagctgagccaaagtgccagcagccaggcccacctgggggcctctgggagcctttgtgtgtgatgggtaagcctgtagggcatttccatagcacagtctcctcaggcagccagcaaactgtgaggacagactcctggaggagcaattcttccctaatcagagtagtttactttgtgaggtctaatttgaattggactgttggtgaattgctgctccgatcccttccttcctgggcagctgggcctggacccgctttccaccctggatcgggactcctttggggggacagttcctcttcacccaacctctgcctccccaaagacaacaacaacttaaaaaaacagcttgtgtgtttacttttctggtgaggattcctaaatcgtgtgccctcagaggaataccatgatccagcttcaagggcgagctcagacagaccagggagcaaagcgaatgcacataaagcagcaaggccactgccacaaccacgctgggggcgcttgtcccttctgccccctcctcacacccatgcactgaggccagtcagtaattaacaacgatacggatggctgcatt

SEQ ID NO: 32068 - DNA, 872 bp, Homo sapiens
tatccttgatagctgggatgctgataatgatacagactttcaaggaatcgagattacagtacaatatgccaagtggaactgagaataattaaatgcctttcatttagaccatattttaatcttatagctctaatggctggatcatatttctgcttaacaaatggcaaagctgattaaactgagacaacattgggtatgaagtaacttattattcagtaaaaatagtgtaagtctaaggcataatcaaagataatttcaagatgcagtaataccaacagtgaaaaaatcaagaagctactccaagaaactaagctcagtttttctgccggtatttccaaaatgtaagtcaaacatactttgttacttagatgatttttaaattgtgttaaatatttatagggggaaaagttgctactctaaggtaactatacaaaaagaagctattaggttttccaaattagggatacttctgtgccctcctcagtgtcaacacaggtcttttatggcacaaaacctttgcattctaattgtttcgcatgcttgatatacctccttcagtaacctgaaggtgatttacccacctcagtccccactgcctaagtctatgacttcccaaattgctcagtaaatgctgagtggatatttagtaagaaacctatggacactagggacaaatatgtgttcattaaatatgcatcatatactctgcaagccacctggcctggtctcttcaaaaaggcagtattggccaggttgggtgtcacgcctgtaatcccagcactttgggacccaaggcaggcggatcacttgaggtcaggagttcgagaccagcctggccaacatgatgaaaccccatctctactaaaaataca

SEQ ID NO: 32069 - DNA, 384 bp, Homo sapiens
gctatttatattttgaataaatttattatttaatttttatttagattggattcatgcatagtgatgtcctgctttttatctagctatcttaaaaatttttggccaggcccagtggctcacacctgtaatcccagcactttgggaggtcgaggtggaaggatcccttgagctcaggagtttgagatcagcctgggcgacatagcaaaaccttgtttctacaaaaaatcataaacttagctgcacatggtggcatgtgcctgtggttccgactacttcaggctgttgtgggaggattgcttgagcctgggaagtcaaggctgcggtaagccgtgatcatgccatggcactccagcctggaaaatagagcaagaccctgtctcaaaa

SEQ ID NO: 32070 - DNA, 320 bp, Homo sapiens
aagaaacaactcctggagaggtgtgtcacggtccccaagagactggggatggcttccctggaccacccaggaagacaaaggaagaaaagttcacgtttattgagcatcaaatgtttgctcaccactgttgtgggttgtggtgggggaaggggtggttcaactcagtaattacgcccacgtggcaatgctacgaaggtcatataattaccattttgcaaacagggaaactgaggctcaaacatgaaggttccaaggtcatccagcaggtgagtggcagaggcaggatttgctttgcacctgggccccatccaccaggttcg

SEQ ID NO: 32071 - DNA, 384 bp, Homo sapiens
tcctggctaacacggtgaaaccccatctctactaaaaatacaaaaaattagccggacatggtagcgggcgcctatagtcccagctacttgggaggctgaggcaagagaatggcgtgaacccaggaggcagagtttgcagtgaacagagatcgcgccactgcactccagcctgcctggagtgctttatttttgagatagagcgagactctatctcaaaaataaaataaaataaaataaaatagacatagtaagtaatatgatgttcaaggcaactcaatatgcacaatgcatacataatatgtaattgaaaaaattatgaaacaatatttacctgacttcattcaataaagtccaatattttaaaatctattctatgttacttaa

SEQ ID NO: 32072 - DNA, 319 bp, Homo sapiens
actcaaaggaatatattgcttctatttaaaatcattcttaaaacagatgcaggtggaggcaggtttgaggttgaggagtggtattagtgtggtagcagccactgttgtttcaaacctcttcccaccctgccctaagaagatcggaaacctctcctctctcttgcattttgtgttcctgtacagttgatccctcagtagaatgcaaaagttcatttgcatgacatgtagttgctgaagacacatgacccatccctaaactcagactaggacatttttacaaatacttttgcaaattgaagtcaggaatcttccagccatc

SEQ ID NO: 32073 - DNA, 465 bp, Homo sapiens
ctcctgaagggaatggcatttcctacaatcgataaacctgggaagagttcaaagatgggacaggaaataaggaattgaaacacgcggcctggatttttaaacttcataggggacagactcttttgctattatgtctactcaaggtcgagtaaacacaggtgttcacatgatgatgatgccttggttgcgtgtaaaaagactcagaatttaagtaattcgagtaactaattactaggccatatcaggaaatgactgacttccaattgccaaatggcttgtggtgccatcatttgaacaatcccagattgagttccattaattgcaatgataacagacaaaccactgtgttatgcaattatgaatacaaggtcattgttgtgatgtctataaaatgccttaatgtgggggataatcttctatgtaccacattggtgttgccaatacatgtttctgccgcaaaacaaa

SEQ ID NO: 32074 - DNA, 488 bp, Homo sapiens
ggctgcatatcggcatcaccacaggaagtttcaaaaattccagtgcctgagtcccaccacagggtctttggtggctcagatgaaccaatcccagtgccttctaacagttggagagtaagaaggatcctggagcgggggaacttctgacagctcctgctcatccccggagaagacagaagcccatcacctggtacacttcagaggaacacgcacctgacagccaaggagaactgagcaatagtcctcggatgttgggcgtcattttccgtgggcagttgggagtcactgtgcttctcccacaaaaactcttctcacagtccaacttgtatacaaacccatcagactgctagccccagggcaggtgcaactgtacgtgagatcagcggccaaccaccaccctttcccaggccacactccatcagcaagagactatgctacaccccaagacgagatgcagccaataaacatgtctatgtattgacctgaaa

SEQ ID NO: 32075 - DNA, 612 bp, Homo sapiens
ggctgcatatcggcatcaccacaggaagtttcaaaaattccagtgcctgagtcccaccacagggtctttggtggctcagatgaaccaatcccagtgccttctaacagttggagagtaagaaggatcctggagcgggggaacttctgacagctcctgctcatccccggagaagacagaagcccatcacctggtacacttcagaggaacacgcacctgacagccaaggagaactgagcaatagtcctcggatgttgggcgtcattttccgtgggcagttgggagtcactgtgcttctcccacaaaaactcttctcacagtccaacttgtatacaaacccatcagactgctagccccagggcaggtacctacctatcttcctgtcccagtactgaggggctcaataactattgttaacctgaagacaccgaaaaccttgacagcgctgagcttgttacagcaccatcttgctgtgtgtccatgtgcaggtgcaactgtacgtgagatcagcggccaaccaccaccctttcccaggccacactccatcagcaagagactatgctacaccccaagacgagatgcagccaataaacatgtctatgtattgacctgaaa

SEQ ID NO: 32076 - DNA, 449 bp, Homo sapiens
aggccaggtaaaggcagcccagaccagatctaaatgaaacgctgtgggctaagttttcattcacagaagatgggcagagtggcagatcagaggtaactatcaatgatacaaacttcaaggaaatgatgagatacagaggaccaaagttaaagtcaatgatatatgtgaagcatgatgattttccaagccatacccaaaccctatgagctgtgcatgttatacccagcagtttaatcctggaagactcttggtgcatgttgcagggatgagttagctcagtgtgatgtagttaaagagcagtgggattggggtcaggtgatctggggtctgaacctagttctgtcactccttgtgtatactgggacaagtccatctcccacctgaggtctcagttttaccaactgtcaaaagattgccctaaaagttcatagaccccttcgaaaatctga

SEQ ID NO: 32077 - DNA, 802 bp, Homo sapiens
cttcccagccttccaagtctactgctcgtcctgtgggacccagagatcttcacagtctcaatggcacaagacggaacgttcacttccaggcaacaatcctgcgccacaggactcagttcagcccccaagtatcagactcccggccctgttcttggtgttcagagcccactaaaccagcagtcttgccacacagctttgtctccagaggccagctcatctgctttttttcacactactccagcaaccctgctccaccaagcacgcacactctccttgacacagggctccagaccaaccacatggcctgtgctcctgaaaatgcctgcctgaaggcccagggagtccagacactggcagatgagaatggacgaaaagaagccaagccagaagccaggaagcaataaatgctagacccagaaaggccttaggtttgagtgacccagctccatccctccatcctggatccttggaggacagccccaagttcagcctaggagctcccaaggcccctccactacctgccagctctccgacagcacaagagacacagcaatcccacatcagtcaacaacccaccgccacaggattcctaggggcaaggctctgcccctccccccagcacatatgtcagaggggtggcttccctgggttacacccctcctgctgttgggggagtggggggtcggggaacacagctttccagatgtgcttggcaactcctactagaaaagactaggggtgcgggggacaggagaagacatggataaataactttaacaccgctccaacccatccggctcag

SEQ ID NO: 32078 - DNA, 1869 bp, Homo sapiens
taccccaaggcatactcaactgataatctccagctagatgagtaaaacagtatgtgtttagttttccagagaattctagcaagtttcatattttcttccaagttagtatagaactaactataggaagtatggggttgctttttcctccagtagaatattaaagatgggggagggtgggcaatgtagtgacagaaaatgattctctcagaatgaacttttcagagaaagagcagcataaaccaggtgcacatcatgatttgggagtttttgcgtaatttattctgttatttatttgggctcgccatgtgttctggggttaggatgctgcaggtcattcatcttcttaatgcctgtctggtcttaagccaactgttctttctttcctcgaccctctctgccctgtagctctccccacaaaaatgcatgataccatgaccttacgtgtgggatggggtatgtagtgtagcaaagaaaagaaagtatagttatattgagtcctaagacatttgttagggaaaagcataagagaaaatggggtgggaggtggggaaatgatatttgactttcaaaattgaaataggttttttttttgcagaaattaaatgggatgtttttcattctagaataaaagaatgtgaattctctttgctgctcttgtttaagctaaaagtagtgtttacttgataaggctctctgaccatttaatttttatcagaaaatgtggggatgtcaggaaagtggcttcctgaacgttggggcgggataattgtcctcaaaagtatgatggttaatacatgaaaggaagactttgttggacagtttcgaagatgggcttttaaggagttgggtttttgtggggtacttttttgttttttaagccacaaaatcctcaatatgtttgttttaggatggaagtgaggatttgtatgagactgtcagctattaattttaaggaaatcttaaaatttacatttacatcagtaaatgaagatgacagtgtgtatatatgtgataaatagtgaaacagaaaagacagttctggtattcataacgtgaaagaaaggggttttattctttctgtgtctgtgatttaaaactccgtgaccatgctctgacttttgtatttcaacctgagtttaaacaaataaacaagatattttttaaagaaagcataacatagtgtgtcttagcaaggacatgattcatatggaagcagaatgtgagaagttgtaaggtccttggtactcactgtaaaatcacagacagagaattggtaggggttgtgaatacactagtaccacttaaagttcagtgatacagttcagaaatagggtccttaagtattttgaaagagtttactcttcagtcagcttagatgagagctctctccctgctcccctctaccctctcaaaagttgagagtaaatagaatttggtttgattccagggaggggaaaataagcagagaataggacttttatactttccaataccaggaataaaatgtttgtgatatatatgggtccagcaaacctatcgagataatgtgaatacgataaacttcctaatggcaggatattcactctcaatcctgaagttaccggttcctgcagaattgagcttcagctgttactgttttgaagccgctgtaaattactgctttccccagttcccccactattttttttaagtgggcgggggcgcctgttaagatctaaaatagatatgttggattgatattctcacgtgttcggtgtggaaaacaaaacaagtacatgctttagaagcaacaacaatgaaatccttttgaaatgtgtgttaatatcgtttaataaaataactagtttgaaaggtttgacatttttcttt

SEQ ID NO: 32079 - DNA, 6129 bp, Homo sapiens
  misc_feature (1586)..(1586): n is a, c, g, or t
  misc_feature (2225)..(2225): n is a, c, g, or t
atgctgtaacttctctttctgtttcctttcccatgctatttcatcccctccttccccacctcatttctccaccccttgaccctgggacactagccgggaaccagaggctccagcaggtcatgcacgcggcggatcctctggagatccaggctgacgtgcactggactcatatccgtgagagagaggaggaagagaggatggcgccggcctctgagtcctctgcttccggagccccattggatgagaatgacctagaggaagatgtggactcagaaccagccgagatagaaggggaggcagcagaggatggggacccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccctcggatctgaaagctgtgcactctcccatccgatcacagccagtgaccctgccagaagctaggactcctgtctcaccagggagcccgcagccccagccacccgtggcggcctccacgcccccacccagcccactccccatctgctcccagccccagccttccaccgaggccactgtcccatcccctacccagtcccccatacgcttccagcctgccccggccaaaacatccaccccactggcccctctccctgtccaaagccaaagtgacaccaaggacagactgggcagcccccttgctgtggatgaggccctcagacggagcgacctggtggaggagttctggatgaagagtgcggagatccgccgcagcctcgggctcacacctgtggaccgcagcaaggggcccgagcccagcttccccacgcctgccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagngtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggatgccatggccaggcagctgagcaggatgcagcagatggagctggcctcaggcgcccccaggccccgcaaggcgtcctcagcaccctcccagggcaaggagcgccggcctgactcccccacacgccccactctcaggggctccgaggagcccaccctgaagcatgaagccaccagcgaggaggtcctctccccgccgtcggactcagggggcccagatggctctttcacttcatccgagggctccagtgggaagagcaagaagaggtcgtcactcttctccccccgcagaaacaagaaggagaagaagtccaaaggcgagggccggcccccggagaagcccagctccaacctcctngaagaagccgccgccaaacccaagtccctgtggaagtccgtcttctccgggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcaggcatgggcaagaaggacgaccccaagctgatgcaggagtggttcaagctagtgcaggagaagaacgccatggtgcgctacgagtcggagctgatgatctttgcccgggagctggagctggaagaccggcagagtcgactgcagcaggagctccgggaacgcatggcagtggaagatcaccttaagactgaggagggctgtcagaagagaagcagattctcaatgagatgctggaggtggtggagcagagagactcactggtggcgctgctggaggagcagcggctccgggagagagaggaggacaaggacctggaggctgccatgctgtccaagggcttcagccttaactggtcctgagctcccacccaacgctccattttctgttggcatccgcctggccaggcagtggcatccaaaccacccggagccgcgatctgaggaggcctggcacctccttggagtttacgctcagatgcccgtgtgctgcttggaaagtggtcgagtcccgcgtgcagtggggagccccaggtgacagtggttatctgagacggctccacctcctgggaggaggcccacctggacctcccactcagaggagcagcacggcgtgtatggcatgacgcaggggaccaccccgcgcgctccctgaggatgtgctggctgtgccccttttttccactggcacatttggtaagagagggaagctgctccccgtcagaaccacagtgcgccgtgcgaggggcactgtcttcttcatgctccctggagcaccaccaaagaaacgtaaacaataccccacgaaagcagggtcaggggtcagggtgcgatcgagacccaggatgggggcgtccagtcatgcccaccccagcatcacaggagacatggaggtgcgggcaggctcctgaattattatgcaaattaggaggacgcaggaggggtctgccctccagccgaacaccacacactggaccctaagtggccaaatgcctgggccgcttgctggctgtggcctgaggcttgtgggttgctgcattttgcttgtagttcacaaccattttgacactggaaaatgctgactttgggggacaggatgaggccctacattctaagcccccagttggcagacaggcattgtccctgttccacatttatgtcgggacaggagatgaccttttcctccgtgtttttcctgtgtttgcacgttgaaatgaagctgacaacctggcaagacgctcagccgcttcaaaccctttttgtcaattaacttattttttaatacttgaaaagaagtaacttcgtttgtgtatctttactagaggaactgatcacctgcgcccgggtgcgggagccacagcggcatctggtgcgtcctacgcgacctggtccggggctgcccggtgctcctcacgtgcatctatttattagcctttctcttcgtatcactggcctggctggcatcagggagctgcccagaacccctgtgtgggtcctcctcacagctttctgtcccctcctccacccggtgcctgcctcaccctggcgctagaccatctggaccactcatgtgatgagggtgcatttccgttctgttttgggccaggccaacagcagagctgccactctcaccctcccagtgagaattccggctctgcagaactcgcccttgtctcagtttgggggccagggcatcaccttcctccgcacatatgttaaagaaggtttcaggatgggccctcatccacacaggccaagagggtgcaaggtgggaccctggaatcatgtggctggtgagaattccctcctcccagcctaagattcacccagacggaaacgcgagtgctgcagtggatgctgggatgcaggctggtgcctctcaagcagatcagcgactcccgcccttccttccgaaggcgacgggcacctgccttgtgccggatcttcatggggacataaagggcgagccccgaatcactagctcctatagccaaactgttcctttctcacggttccgcaccagcctggctgtgtacagctcatcaagccactgagctaatcggggtggggtgcttgtccatcaaagcagtcagcacatagcccagcgaggagccatccggaccagacccgcctgccaggggcgctccagccgcctgccgcctccgtgggctggggccagctgggagcagaggcctggcccctccaaggcgtcccgcagtggagcaggctgagtggctgtgctgaccttgggctttccatgggaaccacactgtgcttcaacttgaacattcatcccagctgcaaaggagcaaagaacctgtgtcatccttgtctgtccagaagctgccatctctctcccatgcacatccgggagataacgccgctagtggccgccacagcgctgattctccacctgttctcacgtgaggcaaaggtctccttttcttttctctttacttaaaaaaggggagaggagggtttctagattccatcttcaaaccccagtcgtcccataaaattggacgtgggaaaagaccttcactgcctgcgtggcctttcccagacctctcctcgaatgccacaaaaccggtccagccccggcagagccgccttcggcccttgtagctcctgctggccccacaacagggaaacagtttgcaaagtggcttggaaggagtgtggcctagggatctgctgtaagtggccagacgtagcaggagagcccagtgtcaccttctggtcctggtcagccttaacactgtggcatcctccacagcacacacggcagcctgcagtctggaaggtggacccgagcctttgcagagaggcgccgcagagccgcaggcctgcgccccagccttctgctcccgactgtgaggacacccagttctagtagagcactttttttaaagctcccattttgtaaccactagtttgcggttgacttgagtactctggtgacttcctgcgtcaagcgttctcaagctgtgagaatgtgcgcagctccaggcaggttttctctcggagagttaagtcttcccttgaaggcagggaagcaggatggatacacatatatcacacgcataaaacaccaggtgcgggagcagcccagactcaaggctgactaaactggaggctgaataccgtggaggtccacatgcagcttccctggagggcaggccggaggcgctcccgcccctgggcttgaggatgctgcaccccgtgggcttccaggcctgcccagatgatgccttcaggcctctgtccctggcggccatcctcaggccgattttgaccagcaatgatagactcttcttaaccctttcaaaataaatttttcagtgggacagaaaggagagttaaaaaacatttttttaaaggtggtaacatctgacccacaaagggaatgggtctgttttatgcaaaataaaagtttttcaaataaa

SEQ ID NO: 32080 - DNA, 492 bp, Homo sapiens
atgctgtaacttctctttctgtttcctttcccatgctatttcatcccctccttccccacctcatttctccaccccttgaccctgggacactagccgggaaccagaggctccagcaggtcatgcacgcggcggatcctctggagatccaggctgacgtgcactggactcatatccgtgagagagaggaggaagagaggatggcgccggcctctgagtcctctgcttccggaggtaaacactcccagccccaggccgcagtgtgccccgagcaccacccgcctgctgcctctgtcgccacagggggcctttctgtcagggcagagccacccatgaggtcacacacgggagccaggcgcatcccgctttgctgctgtcagttgtgacacctgtacttttcatctgaggatatgtaaagttctctgtggattaagaggttgtggactctttctccattgatgcaaaatggtaaaatgaacctgatcttgggtaaac

SEQ ID NO: 32081 - DNA, 6161 bp, Homo sapiens
  misc_feature (1618)..(1618): n is a, c, g, or t
  misc_feature (2257)..(2257): n is a, c, g, or t
caatgcccccaccttcagccgctcttctcttcccacttggcccctagcattgagaaatgcccacctcctgtgtttgggggccccgggccccccccagcacccatgctacgtgtggagagccccctgggcctggcagcatctcccctctcctggggcctgcatggcagcgccctgagaaaggcagtacctctcgcccccgtgaagatgcagcctgtctgtctgtcctccttttcttccttcctttgaacctttctgctttgcagccccattggatgagaatgacctagaggaagatgtggactcagaaccagccgagatagaaggggaggcagcagaggatggggacccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccctcggatctgaaagctgtgcactctcccatccgatcacagccagtgaccctgccagaagctaggactcctgtctcaccagggagcccgcagccccagccacccgtggcggcctccacgcccccacccagcccactccccatctgctcccagccccagccttccaccgaggccactgtcccatcccctacccagtcccccatacgcttccagcctgccccggccaaaacatccaccccactggcccctctccctgtccaaagccaaagtgacaccaaggacagactgggcagcccccttgctgtggatgaggccctcagacggagcgacctggtggaggagttctggatgaagagtgcggagatccgccgcagcctcgggctcacacctgtggaccgcagcaaggggcccgagcccagcttccccacgcctgccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagngtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggatgccatggccaggcagctgagcaggatgcagcagatggagctggcctcaggcgcccccaggccccgcaaggcgtcctcagcaccctcccagggcaaggagcgccggcctgactcccccacacgccccactctcaggggctccgaggagcccaccctgaagcatgaagccaccagcgaggaggtcctctccccgccgtcggactcagggggcccagatggctctttcacttcatccgagggctccagtgggaagagcaagaagaggtcgtcactcttctccccccgcagaaacaagaaggagaagaagtccaaaggcgagggccggcccccggagaagcccagctccaacctcctngaagaagccgccgccaaacccaagtccctgtggaagtccgtcttctccgggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcaggcatgggcaagaaggacgaccccaagctgatgcaggagtggttcaagctagtgcaggagaagaacgccatggtgcgctacgagtcggagctgatgatctttgcccgggagctggagctggaagaccggcagagtcgactgcagcaggagctccgggaacgcatggcagtggaagatcaccttaagactgaggagggctgtcagaagagaagcagattctcaatgagatgctggaggtggtggagcagagagactcactggtggcgctgctggaggagcagcggctccgggagagagaggaggacaaggacctggaggctgccatgctgtccaagggcttcagccttaactggtcctgagctcccacccaacgctccattttctgttggcatccgcctggccaggcagtggcatccaaaccacccggagccgcgatctgaggaggcctggcacctccttggagtttacgctcagatgcccgtgtgctgcttggaaagtggtcgagtcccgcgtgcagtggggagccccaggtgacagtggttatctgagacggctccacctcctgggaggaggcccacctggacctcccactcagaggagcagcacggcgtgtatggcatgacgcaggggaccaccccgcgcgctccctgaggatgtgctggctgtgccccttttttccactggcacatttggtaagagagggaagctgctccccgtcagaaccacagtgcgccgtgcgaggggcactgtcttcttcatgctccctggagcaccaccaaagaaacgtaaacaataccccacgaaagcagggtcaggggtcagggtgcgatcgagacccaggatgggggcgtccagtcatgcccaccccagcatcacaggagacatggaggtgcgggcaggctcctgaattattatgcaaattaggaggacgcaggaggggtctgccctccagccgaacaccacacactggaccctaagtggccaaatgcctgggccgcttgctggctgtggcctgaggcttgtgggttgctgcattttgcttgtagttcacaaccattttgacactggaaaatgctgactttgggggacaggatgaggccctacattctaagcccccagttggcagacaggcattgtccctgttccacatttatgtcgggacaggagatgaccttttcctccgtgtttttcctgtgtttgcacgttgaaatgaagctgacaacctggcaagacgctcagccgcttcaaaccctttttgtcaattaacttattttttaatacttgaaaagaagtaacttcgtttgtgtatctttactagaggaactgatcacctgcgcccgggtgcgggagccacagcggcatctggtgcgtcctacgcgacctggtccggggctgcccggtgctcctcacgtgcatctatttattagcctttctcttcgtatcactggcctggctggcatcagggagctgcccagaacccctgtgtgggtcctcctcacagctttctgtcccctcctccacccggtgcctgcctcaccctggcgctagaccatctggaccactcatgtgatgagggtgcatttccgttctgttttgggccaggccaacagcagagctgccactctcaccctcccagtgagaattccggctctgcagaactcgcccttgtctcagtttgggggccagggcatcaccttcctccgcacatatgttaaagaaggtttcaggatgggccctcatccacacaggccaagagggtgcaaggtgggaccctggaatcatgtggctggtgagaattccctcctcccagcctaagattcacccagacggaaacgcgagtgctgcagtggatgctgggatgcaggctggtgcctctcaagcagatcagcgactcccgcccttccttccgaaggcgacgggcacctgccttgtgccggatcttcatggggacataaagggcgagccccgaatcactagctcctatagccaaactgttcctttctcacggttccgcaccagcctggctgtgtacagctcatcaagccactgagctaatcggggtggggtgcttgtccatcaaagcagtcagcacatagcccagcgaggagccatccggaccagacccgcctgccaggggcgctccagccgcctgccgcctccgtgggctggggccagctgggagcagaggcctggcccctccaaggcgtcccgcagtggagcaggctgagtggctgtgctgaccttgggctttccatgggaaccacactgtgcttcaacttgaacattcatcccagctgcaaaggagcaaagaacctgtgtcatccttgtctgtccagaagctgccatctctctcccatgcacatccgggagataacgccgctagtggccgccacagcgctgattctccacctgttctcacgtgaggcaaaggtctccttttcttttctctttacttaaaaaaggggagaggagggtttctagattccatcttcaaaccccagtcgtcccataaaattggacgtgggaaaagaccttcactgcctgcgtggcctttcccagacctctcctcgaatgccacaaaaccggtccagccccggcagagccgccttcggcccttgtagctcctgctggccccacaacagggaaacagtttgcaaagtggcttggaaggagtgtggcctagggatctgctgtaagtggccagacgtagcaggagagcccagtgtcaccttctggtcctggtcagccttaacactgtggcatcctccacagcacacacggcagcctgcagtctggaaggtggacccgagcctttgcagagaggcgccgcagagccgcaggcctgcgccccagccttctgctcccgactgtgaggacacccagttctagtagagcactttttttaaagctcccattttgtaaccactagtttgcggttgacttgagtactctggtgacttcctgcgtcaagcgttctcaagctgtgagaatgtgcgcagctccaggcaggttttctctcggagagttaagtcttcccttgaaggcagggaagcaggatggatacacatatatcacacgcataaaacaccaggtgcgggagcagcccagactcaaggctgactaaactggaggctgaataccgtggaggtccacatgcagcttccctggagggcaggccggaggcgctcccgcccctgggcttgaggatgctgcaccccgtgggcttccaggcctgcccagatgatgccttcaggcctctgtccctggcggccatcctcaggccgattttgaccagcaatgatagactcttcttaaccctttcaaaataaatttttcagtgggacagaaaggagagttaaaaaacatttttttaaaggtggtaacatctgacccacaaagggaatgggtctgttttatgcaaaataaaagtttttcaaataaa

SEQ ID NO: 32082 - DNA, 5982 bp, Homo sapiens
  misc_feature (1439)..(1439): n is a, c, g, or t
  misc_feature (2078)..(2078): n is a, c, g, or t
caggagggtgctcttggccgggcccctcaggagcgggggtggtctggtaggcaggtctgtccctgcgtaagaagggcctccaggcctgcacctgagcagctgtgttgcaaatgagcaagtggcgcggctgctctcaggtggaaaaggagttggcctcacttagggtgtgcacccacttctgccccttccctctgccagatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccctcggatctgaaagctgtgcactctcccatccgatcacagccagtgaccctgccagaagctaggactcctgtctcaccagggagcccgcagccccagccacccgtggcggcctccacgcccccacccagcccactccccatctgctcccagccccagccttccaccgaggccactgtcccatcccctacccagtcccccatacgcttccagcctgccccggccaaaacatccaccccactggcccctctccctgtccaaagccaaagtgacaccaaggacagactgggcagcccccttgctgtggatgaggccctcagacggagcgacctggtggaggagttctggatgaagagtgcggagatccgccgcagcctcgggctcacacctgtggaccgcagcaaggggcccgagcccagcttccccacgcctgccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagngtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggatgccatggccaggcagctgagcaggatgcagcagatggagctggcctcaggcgcccccaggccccgcaaggcgtcctcagcaccctcccagggcaaggagcgccggcctgactcccccacacgccccactctcaggggctccgaggagcccaccctgaagcatgaagccaccagcgaggaggtcctctccccgccgtcggactcagggggcccagatggctctttcacttcatccgagggctccagtgggaagagcaagaagaggtcgtcactcttctccccccgcagaaacaagaaggagaagaagtccaaaggcgagggccggcccccggagaagcccagctccaacctcctngaagaagccgccgccaaacccaagtccctgtggaagtccgtcttctccgggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcaggcatgggcaagaaggacgaccccaagctgatgcaggagtggttcaagctagtgcaggagaagaacgccatggtgcgctacgagtcggagctgatgatctttgcccgggagctggagctggaagaccggcagagtcgactgcagcaggagctccgggaacgcatggcagtggaagatcaccttaagactgaggagggctgtcagaagagaagcagattctcaatgagatgctggaggtggtggagcagagagactcactggtggcgctgctggaggagcagcggctccgggagagagaggaggacaaggacctggaggctgccatgctgtccaagggcttcagccttaactggtcctgagctcccacccaacgctccattttctgttggcatccgcctggccaggcagtggcatccaaaccacccggagccgcgatctgaggaggcctggcacctccttggagtttacgctcagatgcccgtgtgctgcttggaaagtggtcgagtcccgcgtgcagtggggagccccaggtgacagtggttatctgagacggctccacctcctgggaggaggcccacctggacctcccactcagaggagcagcacggcgtgtatggcatgacgcaggggaccaccccgcgcgctccctgaggatgtgctggctgtgccccttttttccactggcacatttggtaagagagggaagctgctccccgtcagaaccacagtgcgccgtgcgaggggcactgtcttcttcatgctccctggagcaccaccaaagaaacgtaaacaataccccacgaaagcagggtcaggggtcagggtgcgatcgagacccaggatgggggcgtccagtcatgcccaccccagcatcacaggagacatggaggtgcgggcaggctcctgaattattatgcaaattaggaggacgcaggaggggtctgccctccagccgaacaccacacactggaccctaagtggccaaatgcctgggccgcttgctggctgtggcctgaggcttgtgggttgctgcattttgcttgtagttcacaaccattttgacactggaaaatgctgactttgggggacaggatgaggccctacattctaagcccccagttggcagacaggcattgtccctgttccacatttatgtcgggacaggagatgaccttttcctccgtgtttttcctgtgtttgcacgttgaaatgaagctgacaacctggcaagacgctcagccgcttcaaaccctttttgtcaattaacttattttttaatacttgaaaagaagtaacttcgtttgtgtatctttactagaggaactgatcacctgcgcccgggtgcgggagccacagcggcatctggtgcgtcctacgcgacctggtccggggctgcccggtgctcctcacgtgcatctatttattagcctttctcttcgtatcactggcctggctggcatcagggagctgcccagaacccctgtgtgggtcctcctcacagctttctgtcccctcctccacccggtgcctgcctcaccctggcgctagaccatctggaccactcatgtgatgagggtgcatttccgttctgttttgggccaggccaacagcagagctgccactctcaccctcccagtgagaattccggctctgcagaactcgcccttgtctcagtttgggggccagggcatcaccttcctccgcacatatgttaaagaaggtttcaggatgggccctcatccacacaggccaagagggtgcaaggtgggaccctggaatcatgtggctggtgagaattccctcctcccagcctaagattcacccagacggaaacgcgagtgctgcagtggatgctgggatgcaggctggtgcctctcaagcagatcagcgactcccgcccttccttccgaaggcgacgggcacctgccttgtgccggatcttcatggggacataaagggcgagccccgaatcactagctcctatagccaaactgttcctttctcacggttccgcaccagcctggctgtgtacagctcatcaagccactgagctaatcggggtggggtgcttgtccatcaaagcagtcagcacatagcccagcgaggagccatccggaccagacccgcctgccaggggcgctccagccgcctgccgcctccgtgggctggggccagctgggagcagaggcctggcccctccaaggcgtcccgcagtggagcaggctgagtggctgtgctgaccttgggctttccatgggaaccacactgtgcttcaacttgaacattcatcccagctgcaaaggagcaaagaacctgtgtcatccttgtctgtccagaagctgccatctctctcccatgcacatccgggagataacgccgctagtggccgccacagcgctgattctccacctgttctcacgtgaggcaaaggtctccttttcttttctctttacttaaaaaaggggagaggagggtttctagattccatcttcaaaccccagtcgtcccataaaattggacgtgggaaaagaccttcactgcctgcgtggcctttcccagacctctcctcgaatgccacaaaaccggtccagccccggcagagccgccttcggcccttgtagctcctgctggccccacaacagggaaacagtttgcaaagtggcttggaaggagtgtggcctagggatctgctgtaagtggccagacgtagcaggagagcccagtgtcaccttctggtcctggtcagccttaacactgtggcatcctccacagcacacacggcagcctgcagtctggaaggtggacccgagcctttgcagagaggcgccgcagagccgcaggcctgcgccccagccttctgctcccgactgtgaggacacccagttctagtagagcactttttttaaagctcccattttgtaaccactagtttgcggttgacttgagtactctggtgacttcctgcgtcaagcgttctcaagctgtgagaatgtgcgcagctccaggcaggttttctctcggagagttaagtcttcccttgaaggcagggaagcaggatggatacacatatatcacacgcataaaacaccaggtgcgggagcagcccagactcaaggctgactaaactggaggctgaataccgtggaggtccacatgcagcttccctggagggcaggccggaggcgctcccgcccctgggcttgaggatgctgcaccccgtgggcttccaggcctgcccagatgatgccttcaggcctctgtccctggcggccatcctcaggccgattttgaccagcaatgatagactcttcttaaccctttcaaaataaatttttcagtgggacagaaaggagagttaaaaaacatttttttaaaggtggtaacatctgacccacaaagggaatgggtctgttttatgcaaaataaaagtttttcaaataaa

SEQ ID NO: 32083 - DNA, 6182 bp, Homo sapiens
  misc_feature (1618)..(1618): n is a, c, g, or t
  misc_feature (2257)..(2257): n is a, c, g, or t
caatgcccccaccttcagccgctcttctcttcccacttggcccctagcattgagaaatgcccacctcctgtgtttgggggccccgggccccccccagcacccatgctacgtgtggagagccccctgggcctggcagcatctcccctctcctggggcctgcatggcagcgccctgagaaaggcagtacctctcgcccccgtgaagatgcagcctgtctgtctgtcctccttttcttccttcctttgaacctttctgctttgcagccccattggatgagaatgacctagaggaagatgtggactcagaaccagccgagatagaaggggaggcagcagaggatggggacccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccctcggatctgaaagctgtgcactctcccatccgatcacagccagtgaccctgccagaagctaggactcctgtctcaccagggagcccgcagccccagccacccgtggcggcctccacgcccccacccagcccactccccatctgctcccagccccagccttccaccgaggccactgtcccatcccctacccagtcccccatacgcttccagcctgccccggccaaaacatccaccccactggcccctctccctgtccaaagccaaagtgacaccaaggacagactgggcagcccccttgctgtggatgaggccctcagacggagcgacctggtggaggagttctggatgaagagtgcggagatccgccgcagcctcgggctcacacctgtggaccgcagcaaggggcccgagcccagcttccccacgcctgccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagngtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggatgccatggccaggcagctgagcaggatgcagcagatggagctggcctcaggcgcccccaggccccgcaaggcgtcctcagcaccctcccagggcaaggagcgccggcctgactcccccacacgccccactctcaggggctccgaggagcccaccctgaagcatgaagccaccagcgaggaggtcctctccccgccgtcggactcagggggcccagatggctctttcacttcatccgagggctccagtgggaagagcaagaagaggtcgtcactcttctccccccgcagaaacaagaaggagaagaagtccaaaggcgagggccggcccccggagaagcccagctccaacctcctngaagaagccgccgccaaacccaagtccctgtggaagtccgtcttctccgggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcaggcatgggcaagaaggacgaccccaagctgatgcaggagtggttcaagctagtgcaggagaagaacgccatggtgcgctacgagtcggagctgatgatctttgcccgggagctggagctggaagaccggcagagtcgactgcagcaggagctccgggaacgcatggcagtggaagatcaccttaagactgaggagggctgtcagaagagaagcagattctcaatgagatgctggaggtggtggagcagagagactcactggtggcgctgctggaggagcagcggctccgggagagagaggaggacaaggacctggaggctgccatgctgtccaagggcttcagccttaactggtcctgagctcccacccaacgctccattttctgttggcatccgcctggccaggcagtggcatccaaaccacccggagccgcgatctgaggaggcctggcacctccttggagtttacgctcagatgcccgtgtgctgcttggaaagtggtcgagtcccgcgtgcagtggggagccccaggtgacagtggttatctgagacggctccacctcctgggaggaggcccacctggacctcccactcagaggagcagcacggcgtgtatggcatgacgcaggggaccaccccgcgcgctccctgaggatgtgctggctgtgccccttttttccactggcacatttggtaagagagggaagctgctccccgtcagaaccacagtgcgccgtgcgaggggcactgtcttcttcatgctccctggagcaccaccaaagaaacgtaaacaataccccacgaaagcagggtcaggggtcagggtgcgatcgagacccaggatgggggcgtccagtcatgcccaccccagcatcacaggagacatggaggtgcgggcaggctcctgaattattatgcaaattaggaggacgcaggaggggtctgccctccagccgaacaccacacactggaccctaagtggccaaatgcctgggccgcttgctggctgtggcctgaggcttgtgggttgctgcattttgcttgtagttcacaaccattttgacactggaaaatgctgactttgggggacaggatgaggccctacattctaagcccccagttggcagacaggcattgtccctgttccacatttatgtcgggacaggagatgaccttttcctccgtgtttttcctgtgtttgcacgttgaaatgaagctgacaacctggcaagacgctcagccgcttcaaaccctttttgtcaattaacttattttttaatacttgaaaagaagtaacttcgtttgtgtatctttactagaggaactgatcacctgcgcccgggtgcgggagccacagcggcatctggtgcgtcctacgcgacctggtccggggctgcccggtgctcctcacgtgcatctatttattagcctttctcttcgtatcactggcctggctggcatcagggagctgcccagaacccctgtgtgggtcctcctcacagctttctgtcccctcctccacccggtgcctgcctcaccctggcgctagaccatctggaccactcatgtgatgagggtgcatttccgttctgttttgggccaggccaacagcagagctgccactctcaccctcccagtgagaattccggctctgcagaactcgcccttgtctcagtttgggggccagggcatcaccttcctccgcacatatgttaaagaaggtttcaggatgggccctcatccacacaggccaagagggtgcaaggtgggaccctggaatcatgtggctggtgagaattccctcctcccagcctaagattcacccagacggaaacgcgagtgctgcagtggatgctgggatgcaggctggtgcctctcaagcagatcagcgactcccgcccttccttccgaaggcgacgggcacctgccttgtgccggatcttcatggggacataaagggcgagccccgaatcactagctcctatagccaaactgttcctttctcacggttccgcaccagcctggctgtgtacagctcatcaagccactgagctaatcggggtggggtgcttgtccatcaaagcagtcagcacatagcccagcgaggagccatccggaccagacccgcctgccaggggcgctccagccgcctgccgcctccgtgggctggggccagctgggagcagaggcctggcccctccaaggcgtcccgcagtggagcaggctgagtggctgtgctgaccttgggctttccatgggaaccacactgtgcttcaacttgaacattcatcccagctgcaaaggagcaaagaacctgtgtcatccttgtctgtccagaagctgccatctctctcccatgcacatccgggagataacgccgctagtggccgccacagcgctgattctccacctgttctcacgtgaggcaaaggtctccttttcttttctctttacttaaaaaaggggagaggagggtttctagattccatcttcaaaccccagtcgtcccataaaattggacgtgggaaaagaccttcactgcctgcgtggcctttcccagacctctcctcgaatgccacaaaaccggtccagccccggcagagccgccttcggcccttgtagctcctgctggccccacaacagggaaacagtttgcaaagtggcttggaaggagtgtggcctagggatctgctgtaagtggccagacgtagcaggagagcccagtgtcaccttctggtcctggtcagccttaacactgtggcatcctccacagcacacacggcagcctgcagtctggaaggtggacccgagcctttgcagagaggcgccgcagagccgcaggcctgcgccccagccttctgctcccgactgtgaggacacccagttctagtagagcactttttttaaagctcccattttgtaaccactagtttgcggttgacttgagtactctggtgacttcctgcgtcaagcgttctcaagctgtgagaatgtgcgcagctccaggcaggttttctctcggagagttaagtcttcccttgaaggcagggaagcaggatggatacacatatatcacacgcataaaacaccaggtgcgggagcagcccagactcaaggctgactaaactggaggctgaataccgtggaggtccacatgcagcttccctggagggcaggccggaggcgctcccgcccctgggcttgaggatgctgcaccccgtgggcttccaggcctgcccagatgatgccttcaggcctctgtccctggcggccatcctcaggccgattttgaccagcaatgatagactcttcttaaccctttcaaaataaatttttcagtgggacagaaaggagagttaaaaaacatttttttaaaggtggtaacatctgacccacaaagggaatgggtctgttttatgcaaaataaaagtttttcaaataaaaaaaacctcgtgccgaattct

SEQ ID NO: 32084 - DNA, 6025 bp, Homo sapiens
  misc_feature (1618)..(1618): n is a, c, g, or t
  misc_feature (2257)..(2257): n is a, c, g, or t
caatgcccccaccttcagccgctcttctcttcccacttggcccctagcattgagaaatgcccacctcctgtgtttgggggccccgggccccccccagcacccatgctacgtgtggagagccccctgggcctggcagcatctcccctctcctggggcctgcatggcagcgccctgagaaaggcagtacctctcgcccccgtgaagatgcagcctgtctgtctgtcctccttttcttccttcctttgaacctttctgctttgcagccccattggatgagaatgacctagaggaagatgtggactcagaaccagccgagatagaaggggaggcagcagaggatggggacccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccctcggatctgaaagctgtgcactctcccatccgatcacagccagtgaccctgccagaagctaggactcctgtctcaccagggagcccgcagccccagccacccgtggcggcctccacgcccccacccagcccactccccatctgctcccagccccagccttccaccgaggccactgtcccatcccctacccagtcccccatacgcttccagcctgccccggccaaaacatccaccccactggcccctctccctgtccaaagccaaagtgacaccaaggacagactgggcagcccccttgctgtggatgaggccctcagacggagcgacctggtggaggagttctggatgaagagtgcggagatccgccgcagcctcgggctcacacctgtggaccgcagcaaggggcccgagcccagcttccccacgcctgccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagngtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggatgccatggccaggcagctgagcaggatgcagcagatggagctggcctcaggcgcccccaggccccgcaaggcgtcctcagcaccctcccagggcaaggagcgccggcctgactcccccacacgccccactctcaggggctccgaggagcccaccctgaagcatgaagccaccagcgaggaggtcctctccccgccgtcggactcagggggcccagatggctctttcacttcatccgagggctccagtgggaagagcaagaagaggtcgtcactcttctccccccgcagaaacaagaaggagaagaagtccaaaggcgagggccggcccccggagaagcccagctccaacctcctngaagaagccgccgccaaacccaagtccctgtggaagtccgtcttctccgggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcaggcatgggcaagaaggacgaccccaagctgatgcaggagtggttcaagctagtgcaggagaagaacgccatggtgcgctacgagtcggagctgatgatctttgcccgggagctggagctggaagaccggcagagtcgactgcagcaggagctccgggaacgcatggcagtggaagatcaccttaagactgaggagggctgtcagaagagaagcagattctcaatgagatgctggaggtggtggagcagagagactcactggtggcgctgctggaggagcagcggctccgggagagagaggaggacaaggacctggaggctgccatgctgtccaagggcttcagccttaactggtcctgagctcccacccaacgctccattttctgttggcatccgcctggccaggcagtggcatccaaaccacccggagccgcgatctgaggaggcctggcacctccttggagtttacgctcagatgcccgtgtgctgcttggaaagtggtcgagtcccgcgtgcagtggggagccccaggtgacagtggttatctgagacggctccacctcctgggaggaggcccacctggacctcccactcagaggagcagcacggcgtgtatggcatgacgcaggggaccaccccgcgcgctccctgaggatgtgctggctgtgccccttttttccactggcacatttggtaagagagggaagctgctccccgtcagaaccacagtgcgccgtgcgaggggcactgtcttcttcatgctccctggagcaccaccaaagaaacgtaaacaataccccacgaaagcagggtcaggggtcagggtgcgatcgagacccaggatgggggcgtccagtcatgcccaccccagcatcacaggagacatggaggtgcgggcaggctcctgaattattatgcaaattaggaggacgcaggaggggtctgccctccagccgaacaccacacactggaccctaagtggccaaatgcctgggccgcttgctggctgtggcctgaggcttgtgggttgctgcattttgcttgtagttcacaaccattttgacactggaaaatgctgactttgggggacaggatgaggccctacattctaagcccccagttggcagacaggcattgtccctgttccacatttatgtcgggacaggagatgaccttttcctccgtgtttttcctgtgtttgcacgttgaaatgaagctgacaacctggcaagacgctcagccgcttcaaaccctttttgtcaattaacttattttttaatacttgaaaagaagtaacttcgtttgtgtatctttactagaggaactgatcacctgcgcccgggtgcgggagccacagcggcatctggtgcgtcctacgcgacctggtccggggctgcccggtgctcctcacgtgcatctatttattagcctttctcttcgtatcactggcctggctggcatcagggagctgcccagaacccctgtgtgggtcctcctcacagctttctgtcccctcctccacccggtgcctgcctcaccctggcgctagaccatctggaccactcatgtgatgagggtgcatttccgttctgttttgggccaggccaacagcagagctgccactctcaccctcccagtgagaattccggctctgcagaactcgcccttgtctcagtttgggggccagggcatcaccttcctccgcacatatgttaaagaaggtttcaggatgggccctcatccacacaggccaagagggtgcaaggtgggaccctggaatcatgtggctggtgagaattccctcctcccagcctaagattcacccagacggaaacgcgagtgctgcagtggatgctgggatgcaggctggtgcctctcaagcagatcagcgactcccgcccttccttccgaaggcgacgggcacctgccttgtgccggatcttcatggggacataaagggcgagccccgaatcactagctcctatagccaaactgttcctttctcacggttccgcaccagcctggctgtgtacagctcatcaagccactgagctaatcggggtggggtgcttgtccatcaaagcagtcagcacatagcccagcgaggagccatccggaccagacccgcctgccaggggcgctccagccgcctgccgcctccgtgggctggggccagctgggagcagaggcctggcccctccaaggcgtcccgcagtggagcaggctgagtggctgtgctgaccttgggctttccatgggaaccacactgtgcttcaacttgaacattcatcccagctgcaaaggagcaaagaacctgtgtcatccttgtctgtccagaagctgccatctctctcccatgcacatccgggagataacgccgctagtggccgccacagcgctgattctccacctgttctcacgtgaggcaaaggtctccttttcttttctctttacttaaaaaaggggagaggagggtttctagattccatcttcaaaccccagtcgtcccataaaattggacgtgggaaaagaccttcactgcctgcgtggcctttcccagacctctcctcgaatgccacaaaaccggtccagccccggcagagccgccttcggcccttgtagctcctgctggccccacaacagggaaacagtttgcaaagtggcttggaaggagtgtggcctagggatctgctgtaagtggccagacgtagcaggagagcccagtgtcaccttctggtcctggtcagccttaacactgtggcatcctccacagcacacacggcagcctgcagtctggaaggtggacccgagcctttgcagagaggcgccgcagagccgcaggcctgcgccccagccttctgctcccgactgtgaggacacccagttctagtagagcactttttttaaagctcccattttgtaaccactagtttgcggttgacttgagtactctggtgacttcctgcgtcaagcgttctcaagctgtgagaatgtgcgcagctccaggcaggttttctctcggagagttaagtcttcccttgaaggcagggaagcaggatggatacacatatatcacacgccccgtgggcttccaggcctgcccagatgatgccttcaggcctctgtccctggcggccatcctcaggccgattttgaccagcaatgatagactcttcttaaccctttcaaaataaatttttcagtgggacagaaaggagagttaaaaaacatttttttaaaggtggtaacatctgacccacaaagggaatgggtctgttttatgcaaaataaaagtttttcaaataaa

SEQ ID NO: 32085 - DNA, 4344 bp, Homo sapiens
  misc_feature (1618)..(1618): n is a, c, g, or t
  misc_feature (2257)..(2257): n is a, c, g, or t
caatgcccccaccttcagccgctcttctcttcccacttggcccctagcattgagaaatgcccacctcctgtgtttgggggccccgggccccccccagcacccatgctacgtgtggagagccccctgggcctggcagcatctcccctctcctggggcctgcatggcagcgccctgagaaaggcagtacctctcgcccccgtgaagatgcagcctgtctgtctgtcctccttttcttccttcctttgaacctttctgctttgcagccccattggatgagaatgacctagaggaagatgtggactcagaaccagccgagatagaaggggaggcagcagaggatggggacccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccctcggatctgaaagctgtgcactctcccatccgatcacagccagtgaccctgccagaagctaggactcctgtctcaccagggagcccgcagccccagccacccgtggcggcctccacgcccccacccagcccactccccatctgctcccagccccagccttccaccgaggccactgtcccatcccctacccagtcccccatacgcttccagcctgccccggccaaaacatccaccccactggcccctctccctgtccaaagccaaagtgacaccaaggacagactgggcagcccccttgctgtggatgaggccctcagacggagcgacctggtggaggagttctggatgaagagtgcggagatccgccgcagcctcgggctcacacctgtggaccgcagcaaggggcccgagcccagcttccccacgcctgccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagngtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggatgccatggccaggcagctgagcaggatgcagcagatggagctggcctcaggcgcccccaggccccgcaaggcgtcctcagcaccctcccagggcaaggagcgccggcctgactcccccacacgccccactctcaggggctccgaggagcccaccctgaagcatgaagccaccagcgaggaggtcctctccccgccgtcggactcagggggcccagatggctctttcacttcatccgagggctccagtgggaagagcaagaagaggtcgtcactcttctccccccgcagaaacaagaaggagaagaagtccaaaggcgagggccggcccccggagaagcccagctccaacctcctngaagaagccgccgccaaacccaagtccctgtggaagtccgtcttctccgggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcaggcatgggcaagaaggacgaccccaagctgatgcaggagtggttcaagctagtgcaggagaagaacgccatggtgcgctacgagtcggagctgatgatctttgcccgggagctggagctggaagaccggcagagtcgactgcagcaggagctccgggaacgcatggcagtggaagatcaccttaagactgaggagggctgtcagaagagaagcagattctcaatgagatgctggaggtggtggagcagagagactcactggtggcgctgctggaggagcagcggctccgggagagagaggaggacaaggacctggaggctgccatgctgtccaagggcttcagccttaactggtcctgagctcccacccaacgctccattttctgttggcatccgcctggccaggcagtggcatccaaaccacccggagccgcgatctgaggaggcctggcacctccttggagtttacgctcagatgcccgtgtgctgcttggaaagtggtcgagtcccgcgtgcagtggggagccccaggtgacagtggttatctgagacggctccacctcctgggaggaggcccacctggacctcccactcagaggagcagcacggcgtgtatggcatgacgcaggggaccaccccgcgcgctccctgaggatgtgctggctgtgccccttttttccactggcacatttggtaagagagggaagctgctccccgtcagaaccacagtgcgccgtgcgaggggcactgtcttcttcatgctccctggagcaccaccaaagaaacgtaaacaataccccacgaaagcagggtcaggggtcagggtgcgatcgagacccaggatgggggcgtccagtcatgcccaccccagcatcacaggagacatggaggtgcgggcaggctcctgaattattatgcaaattaggaggacgcaggaggggtctgccctccagccgaacaccacacactggaccctaagtggccaaatgcctgggccgcttgctggctgtggcctgaggcttgtgggttgctgcattttgcttgtagttcacaaccattttgacactggaaaatgctgactttgggggacaggatgaggccctacattctaagcccccagttggcagacaggcattgtccctgttccacatttatgtcgggacaggagatgaccttttcctccgtgtttttcctgtgtttgcacgttgaaatgaagctgacaacctggcaagacgctcagccgcttcaaaccctttttgtcaattaacttattttttaatacttgaaaagaagtaacttcgtttgtgtatctttactagaggaactgatcacctgcgcccgggtgcgggagccacagcggcatctggtgcgtcctacgcgacctggtccggggctgcccggtgctcctcacgtgcatctatttattagcctttctcttcgtatcactggcctggctggcatcaggccgattttgaccagcaatgatagactcttcttaaccctttcaaaataaatttttcagtgggacagaaaggagagttaaaaaacatttttttaaaggtggtaacatctgacccacaaagggaatgggtctgttttatgcaaaataaaagtttttcaaataaa

SEQ ID NO: 32086 - DNA, 4004 bp, Homo sapiens
  misc_feature (1618)..(1618): n is a, c, g, or t
  misc_feature (2257)..(2257): n is a, c, g, or t
caatgcccccaccttcagccgctcttctcttcccacttggcccctagcattgagaaatgcccacctcctgtgtttgggggccccgggccccccccagcacccatgctacgtgtggagagccccctgggcctggcagcatctcccctctcctggggcctgcatggcagcgccctgagaaaggcagtacctctcgcccccgtgaagatgcagcctgtctgtctgtcctccttttcttccttcctttgaacctttctgctttgcagccccattggatgagaatgacctagaggaagatgtggactcagaaccagccgagatagaaggggaggcagcagaggatggggacccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccctcggatctgaaagctgtgcactctcccatccgatcacagccagtgaccctgccagaagctaggactcctgtctcaccagggagcccgcagccccagccacccgtggcggcctccacgcccccacccagcccactccccatctgctcccagccccagccttccaccgaggccactgtcccatcccctacccagtcccccatacgcttccagcctgccccggccaaaacatccaccccactggcccctctccctgtccaaagccaaagtgacaccaaggacagactgggcagcccccttgctgtggatgaggccctcagacggagcgacctggtggaggagttctggatgaagagtgcggagatccgccgcagcctcgggctcacacctgtggaccgcagcaaggggcccgagcccagcttccccacgcctgccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagngtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggatgccatggccaggcagctgagcaggatgcagcagatggagctggcctcaggcgcccccaggccccgcaaggcgtcctcagcaccctcccagggcaaggagcgccggcctgactcccccacacgccccactctcaggggctccgaggagcccaccctgaagcatgaagccaccagcgaggaggtcctctccccgccgtcggactcagggggcccagatggctctttcacttcatccgagggctccagtgggaagagcaagaagaggtcgtcactcttctccccccgcagaaacaagaaggagaagaagtccaaaggcgagggccggcccccggagaagcccagctccaacctcctngaagaagccgccgccaaacccaagtccctgtggaagtccgtcttctccgggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcaggcatgggcaagaaggacgaccccaagctgatgcaggagtggttcaagctagtgcaggagaagaacgccatggtgcgctacgagtcggagctgatgatctttgcccgggagctggagctggaagaccggcagagtcgactgcagcaggagctccgggaacgcatggcagtggaagatcaccttaagactgaggagggctgtcagaagagaagcagattctcaatgagatgctggaggtggtggagcagagagactcactggtggcgctgctggaggagcagcggctccgggagagagaggaggacaaggacctggaggctgccatgctgtccaagggcttcagccttaactggtcctgagctcccacccaacgctccattttctgttggcatccgcctggccaggcagtggcatccaaaccacccggagccgcgatctgaggaggcctggcacctccttggagtttacgctcagatgcccgtgtgctgcttggaaagtggtcgagtcccgcgtgcagtggggagccccaggtgacagtggttatctgagacggctccacctcctgggaggaggcccacctggacctcccactcagaggagcagcacggcgtgtatggcatgacgcaggggaccaccccgcgcgctccctgaggatgtgctggctgtgccccttttttccactggcacatttggtaagagagggaagctgctccccgtcagaaccacagtgcgccgtgcgaggggcactgtcttcttcatgctccctggagcaccaccaaagaaacgtaaacaataccccacgaaagcagggtcaggggtcagggtgcgatcgagacccaggatgggggcgtccagtcatgcccaccccagcatcacaggagacatggaggtgcgggcaggctcctgaattattatgcaaattaggaggacgcaggaggggtctgccctccagccgaacaccacacactggaccctaagtggccaaatgcctgggccgcttgctggctgtggcctgaggcttgtgggttgctgcattttgcttgtagttcacaaccattttgacactggaaaatgctgactttgggggacaggatgaggccctacattctaagcccccagttggcagacaggcattgtccctgttccacatttatgtcgggacaggagatgaccttttcctccgtgtttttcctgtgtttgcacgttgaaatgaagctgacaacctggcaagacgctcagccgcttcaaaccctttttgtcaattaacttattttttaatacttga

SEQ ID NO: 32087 - DNA, 3031 bp, Homo sapiens
  misc_feature (1618)..(1618): n is a, c, g, or t
  misc_feature (2257)..(2257): n is a, c, g, or t
caatgcccccaccttcagccgctcttctcttcccacttggcccctagcattgagaaatgcccacctcctgtgtttgggggccccgggccccccccagcacccatgctacgtgtggagagccccctgggcctggcagcatctcccctctcctggggcctgcatggcagcgccctgagaaaggcagtacctctcgcccccgtgaagatgcagcctgtctgtctgtcctccttttcttccttcctttgaacctttctgctttgcagccccattggatgagaatgacctagaggaagatgtggactcagaaccagccgagatagaaggggaggcagcagaggatggggacccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccctcggatctgaaagctgtgcactctcccatccgatcacagccagtgaccctgccagaagctaggactcctgtctcaccagggagcccgcagccccagccacccgtggcggcctccacgcccccacccagcccactccccatctgctcccagccccagccttccaccgaggccactgtcccatcccctacccagtcccccatacgcttccagcctgccccggccaaaacatccaccccactggcccctctccctgtccaaagccaaagtgacaccaaggacagactgggcagcccccttgctgtggatgaggccctcagacggagcgacctggtggaggagttctggatgaagagtgcggagatccgccgcagcctcgggctcacacctgtggaccgcagcaaggggcccgagcccagcttccccacgcctgccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagngtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggatgccatggccaggcagctgagcaggatgcagcagatggagctggcctcaggcgcccccaggccccgcaaggcgtcctcagcaccctcccagggcaaggagcgccggcctgactcccccacacgccccactctcaggggctccgaggagcccaccctgaagcatgaagccaccagcgaggaggtcctctccccgccgtcggactcagggggcccagatggctctttcacttcatccgagggctccagtgggaagagcaagaagaggtcgtcactcttctccccccgcagaaacaagaaggagaagaagtccaaaggcgagggccggcccccggagaagcccagctccaacctcctngaagaagccgccgccaaacccaagtccctgtggaagtccgtcttctccgggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcagactattggggagagtcttattacagtgacctcatcgacttgcatctgggtggtatgtatggcagcgcctgtgctgacactaaccccgctgacgccctttctccacccacgcttcccagtccctgctcacaaaaacaaggagaaatcaacccaataaccaaatggcaaaagcacagacccttttccagctcaaaacagagcagcgtgctgatctccccgctgcccacatgtgctccagaggaagatctgagcttgcttttgctgcctggggtcgtttttaattttttataataaaactttgcccacccgact

SEQ ID NO: 32088 - DNA, 3158 bp, Homo sapiens
  misc_feature (1618)..(1618): n is a, c, g, or t
  misc_feature (2257)..(2257): n is a, c, g, or t
caatgcccccaccttcagccgctcttctcttcccacttggcccctagcattgagaaatgcccacctcctgtgtttgggggccccgggccccccccagcacccatgctacgtgtggagagccccctgggcctggcagcatctcccctctcctggggcctgcatggcagcgccctgagaaaggcagtacctctcgcccccgtgaagatgcagcctgtctgtctgtcctccttttcttccttcctttgaacctttctgctttgcagccccattggatgagaatgacctagaggaagatgtggactcagaaccagccgagatagaaggggaggcagcagaggatggggacccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccctcggatctgaaagctgtgcactctcccatccgatcacagccagtgaccctgccagaagctaggactcctgtctcaccagggagcccgcagccccagccacccgtggcggcctccacgcccccacccagcccactccccatctgctcccagccccagccttccaccgaggccactgtcccatcccctacccagtcccccatacgcttccagcctgccccggccaaaacatccaccccactggcccctctccctgtccaaagccaaagtgacaccaaggacagactgggcagcccccttgctgtggatgaggccctcagacggagcgacctggtggaggagttctggatgaagagtgcggagatccgccgcagcctcgggctcacacctgtggaccgcagcaaggggcccgagcccagcttccccacgcctgccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagngtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggatgccatggccaggcagctgagcaggatgcagcagatggagctggcctcaggcgcccccaggccccgcaaggcgtcctcagcaccctcccagggcaaggagcgccggcctgactcccccacacgccccactctcaggggctccgaggagcccaccctgaagcatgaagccaccagcgaggaggtcctctccccgccgtcggactcagggggcccagatggctctttcacttcatccgagggctccagtgggaagagcaagaagaggtcgtcactcttctccccccgcagaaacaagaaggagaagaagtccaaaggcgagggccggcccccggagaagcccagctccaacctcctngaagaagccgccgccaaacccaagtccctgtggaagtccgtcttctccgggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagtcaatttatgtaccacacgccttggcattcaggagatcatgtgcatcaaagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcagactattggggagagtcttattacagtgacctcatcgacttgcatctgggtggcatgggcaagaaggacgaccccaagctgatgcaggagtggttcaagctagtgcaggagaagaacgccatggtgcgctacgagtcggagctgatgatctttgccggagctggagctggaaaccggagagtcactggagcgagccggacgctgcgtggaatccttaaatgagggggctgcaaaaagcgattcaggtgcggggggggccaaacccgggcctgggcacggccgaaagaggaagcgggtgctcccggccttgtgccccgctttgtccggggggtaccggccggggcgtacggtaagccgggcatccacccagtctctttccctcccctct

SEQ ID NO: 32089 - DNA, 708 bp, Homo sapiens
tcactctgtggatcttaggtgtgcccgtggcactgagggctgctgcaggctggggactctgcagacctcatgccttctgcctatcagcacccccgtcctgctagcactctactctacagaggacagcttgtcctatctgcccgggtaccagctccgacatgggggacagacctctccaggcccctgttggcctgctgcccacccctgtcccaggcctccgtgcacctgactgaggaagtttctcttgttctctccagccaagaacctacacggaggaggaactgaatgccaagctgacccggcgtgtgcaaaaggcagctcggagacaggccaagcaggaggagcttaagcggctgcatcgagcccaggtaaaaccatggaggatgggaccagggcacatgcatgggagggttgggcagcatctccctatccacccagctgctccctgccacacaagcacagtgcagagcagagcagaggtagacgggcctccctgccacccaggtcacctttggctggtgcagccacagaggccctgccttggtggagctgtcagtcaaaagggaagagcaggctgggcgtggtggctcaatgcctgtaatcccagcactttgggaggctgaggcaggcggatcacttcaggtcaggagttcgagaccagcctggccaacatggcaaaaccccgtctctactaaaaaaacaaaaatt

SEQ ID NO: 32090 - DNA, 728 bp, Homo sapiens
gcttatcatgaaaacagtaagcatctcccccaatcccgtctctaaccctcactcctgctccccactggcaaccttttagctctttcttctcgtaataactatcatatttctaaatactatgctattgtgaaatttaataattcattaggataatgaggagttagctcttttacatgccccattttcttcccttattttccgaaatgtctgttcttatttaaatcattgttagtatttacatgaagattcctatataaatgttcattttagagccaaatagggcactataacatttcccttttctaaacagcttttaattttcccttgaataaataatgacctcattattaagcgtgcagaatattctatatgtgattttttcaatgtgttagtgattctctatcatgttttctatgatcgtatctattctgttgagtctactttttcacccagagctcttccttccctgctagaagtttccagcctccaagtccagtttggactagatgctgtcaagagctgctctcgtcctgggagtttcctttatttcttatggattgaaaccatactttttctatatactatttcttcctatgtatttactacaattttgctggtgcatatcttccattagcttcttaggaaacatgacactgaaggtgaactttcaatacccttacatgtctatacattcattgagctaggaactcagtcggctctttaaagtt

SEQ ID NO: 32091 - DNA, 100 bp, Homo sapiens
aaaaggctgaacattatttttacaataaaagcacacaagctgtaacttgaaaaaccagcttgccctcccaagatctgagagtgttagcaaaccactatct

SEQ ID NO: 32092 - DNA, 329 bp, Homo sapiens
ccgagaagtctgccttgaccaccctacataaaataacctcctgttccgggtgcggtggctcacgcctgtaatcccagcactttaggaggctgaggcagacagatcacctggggtcaggagttcgagaccagcctgaccaacatggagaaaccctgtctctactaaaaatacaaaaaattagcggggcgtggtggtgcatgcctgtaatcccagctactcgggaggctgaggcaggagaattgcttgaacccagcgggtggaggttgtgagccaagatcgtgccattgcactccagcctgggcaacaagagcaaaactctgtctccaaaa

SEQ ID NO: 32093 - DNA, 439 bp, Homo sapiens
accaagattattctacatatacttttattttcttttttccccactcaacctgctgtatattgagcctgttttaacctctttaatatttgtacacaccatttttaacagttgtataatgttctatttaacgggtatattatttatttaactggccctctattattggacatatgtagtatttctggttttgccatcataaatattgctgaagtaaatatctttgaaccaaatttgtttgcatttctgattgttacctcaggatagatttctagtaggattaatgagccaaagaatattaatattaaaaagaatattactggccaggtgctgtggctcatgcttgtattcccagcattttgggaggctgagatgggaggatcactagagcccaggagttcgagaccagcctaagaaacataggaagatcctatctcttaaa

SEQ ID NO: 32094 - DNA, 190 bp, Homo sapiens
ggggagggaggggagggatggggggaaagcaagctggaggacaggtgagacagcaggacaggaccggagcagggccccaagcccccgggcctggtgggggacgcgcttcttcccacactgtgagccccaactcccccacctcgggtgtaagcgacaggaagaaataataataatttaagattcaaaaaaa

SEQ ID NO: 32095 - DNA, 374 bp, Homo sapiens
gccttgtgtgtgatcttttctgtcttccccaagtttgcattttcgacattaaagtttactttttagttaaaagttttaagaatatatatatatagatgcactgtagataacatttgtatgccagctacacctttttctacttctgtttggctttttttccccacaccaatggtaatttatcttcacagattgttcttcatttctagaaattgttacttcatggtaattacttgagcaaaagcttgaaaatccctgacaagtacttttcatctcatagtatctccccccctcctattcccttccccccaccccaactcccccacctcgggtgtaagcgacaggaagaaataataataatttaagattcaaaaaaa

SEQ ID NO: 32096 - DNA, 335 bp, Homo sapiens
cacaaggaggtggacagcacagaggaggtggacacaggaggacagaggaggtggacagcacagaggaggcacagaggaggtggacactacagaggaggtggacagcacagggagggctgaaggaaggaaagcaaagggtggacttgtggagggaagacaagggtcggaggaggcaatgaggggacagaaccaggaggccaagctgctgctcctggagaagcctggccaggcccctctcaggctccctggcagagcctagaggtaggggccttggaacctggggagggggggctctgcgtgcctgtgtcccaggcccatatctattttctctgctg

SEQ ID NO: 32097 - DNA, 3676 bp, Homo sapiens
tcacctgtctgaacctcagtttccttgtctgtgaaacagatgatgatcatacttcagagggttctggaagatgaaatgagtgtaaagtactcagaagggtgactggcatgcagtcatccctcaataagtattggctaaagttggtcctctttccccagaccctgtgggctgagcgctcttaatctcccctctacttgactctgcaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccgccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagcaggggtctggggcacggagccttgctggcatcagcatcagcccttcctcccagagccctcattccaattccaagctaagaaggtattggggcagaggctccccaaattggggtgatcccccaaggagtgatacatatattgtgtatatatttacagctgtattgtaaaagtggggtccctgtccccagctgctcctggggagtagaagcaataatgtatttctaatttgtgggtcccacttcggctatgcgggtttctagggggtgggggcttgggaccaaagccttgccccgcccctatgccccttgggggttttggctgtgtaagggggtgaaggactgcccctcccttccgagacccctccttcctggtttctgttcctttttcctggcagtgaattatgcaaagggggccggcaaaggaagggtaggtgggggaaagccaggtggaagcttgaaagactgggggactgggcctgtaaggaaggagccatcccagtccccctccgccctgctcccggcgctgagtcatggggtcgtggagaagggggcggggtggcctgattggctcgcctgcccctgggggcagtagaggggccccgcccagctaggggagccgctccgttccactcccctccctagccctccctccccacggccctgggcagggaatgtcttgttcccgccgctccctccccggggccagagggcagggcgggccgggcggcgtcctaccctcttctcctcctccccatctcctccccgcccaggtgcgagccggagccgccgccaccgctgccgcccctgactcacgccgcccccgggctggcgcagcgaagggtgtgggacagggtaaggggttggaagagccttgtggagagcgggcgagccggcgccatctggcggccatgctctgagtgggcgagcgccccccgcggccactggagcgagctgtcttcacgctcctcatccaccccagctggtgagcggcgcccccttgccaaggcagtgggcacagaacttctcgcttggccgcaggggaaggggctgcggagctgtgggaaagtgatccccttcccagatccttgccagccgggcttcctgtcaggcaggggagaataatccccactctgctcttaggattgaatccacccccattctgtacatagcctcttctgttggtcttgttgaaatctagtttcagatttttaactacccaattctgctgggggtgggggacacccccccttcctcgctgggtgctggaccccttttgcagcctgggctctgccttgcactatttccccttcctggcctgacggctcctccccctccttaaaaggggcaggttcaggggcccggtgctcttcctcccttccatgcacccccatgcccatttgcacagctgcccaggtacccctaacagtggggaggggtcacagggagggggtagcgggaccagtccctgttatctatttaaaaagtgatgatgtaatatattggggtggcggggagatcgggttgtcctgggcctcatcttagcatttcaggtgatggggggagcccagggctggggagacctggggcccagccccagaaagtggggacaatgtggcctcccttctccctactttcggctttcccagtcagtgccttagggggagaggcactccccccctcctattcccttccccccaccccaactcccccacctcgggtgtaagcgacaggaagaaataataataatttaagattcaaaaaaa

SEQ ID NO: 32098 - DNA, 3632 bp, Homo sapiens
ggggagggaggggagggatggggggaaagcaagctggaggacaggtgagacagcaggacaggaccggagcagggccccaagcccccgggcctggtgggggacgcgcttcttcccacactgtgagcctcagcagctccagccagcggacccgacggctgagaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccgccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagcaggggtctggggcacggagccttgctggcatcagcatcagcccttcctcccagagccctcattccaattccaagctaagaaggtattggggcagaggctccccaaattggggtgatcccccaaggagtgatacatatattgtgtatatatttacagctgtattgtaaaagtggggtccctgtccccagctgctcctggggagtagaagcaataatgtatttctaatttgtgggtcccacttcggctatgcgggtttctagggggtgggggcttgggaccaaagccttgccccgcccctatgccccttgggggttttggctgtgtaagggggtgaaggactgcccctcccttccgagacccctccttcctggtttctgttcctttttcctggcagtgaattatgcaaagggggccggcaaaggaagggtaggtgggggaaagccaggtggaagcttgaaagactgggggactgggcctgtaaggaaggagccatcccagtccccctccgccctgctcccggcgctgagtcatggggtcgtggagaagggggcggggtggcctgattggctcgcctgcccctgggggcagtagaggggccccgcccagctaggggagccgctccgttccactcccctccctagccctccctccccacggccctgggcagggaatgtcttgttcccgccgctccctccccggggccagagggcagggcgggccgggcggcgtcctaccctcttctcctcctccccatctcctccccgcccaggtgcgagccggagccgccgccaccgctgccgcccctgactcacgccgcccccgggctggcgcagcgaagggtgtgggacagggtaaggggttggaagagccttgtggagagcgggcgagccggcgccatctggcggccatgctctgagtgggcgagcgccccccgcggccactggagcgagctgtcttcacgctcctcatccaccccagctggtgagcggcgcccccttgccaaggcagtgggcacagaacttctcgcttggccgcaggggaaggggctgcggagctgtgggaaagtgatccccttcccagatccttgccagccgggcttcctgtcaggcaggggagaataatccccactctgctcttaggattgaatccacccccattctgtacatagcctcttctgttggtcttgttgaaatctagtttcagatttttaactacccaattctgctgggggtgggggacacccccccttcctcgctgggtgctggaccccttttgcagcctgggctctgccttgcactatttccccttcctggcctgacggctcctccccctccttaaaaggggcaggttcaggggcccggtgctcttcctcccttccatgcacccccatgcccatttgcacagctgcccaggtacccctaacagtggggaggggtcacagggagggggtagcgggaccagtccctgttatctatttaaaaagtgatgatgtaatatattggggtggcggggagatcgggttgtcctgggcctcatcttagcatttcaggtgatggggggagcccagggctggggagacctggggcccagccccagaaagtggggacaatgtggcctcccttctccctactttcggctttcccagtcagtgccttagggggagaggcactccccccctcctattcccttccccccaccccaactcccccacctcgggtgtaagcgacaggaagaaataataataatttaagattcaaaaaaa

SEQ ID NO: 32099 - DNA, 3624 bp, Homo sapiens
gaggagccccccagcagcgagcggcgagcaactgaccgcggccttctgaccaggaccggagcagggccccaagcccccgggcctggtgggggacgcgcttcttcccacactgtgagcctcagcagctccagccagcggacccgacggctgagaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccgccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagcaggggtctggggcacggagccttgctggcatcagcatcagcccttcctcccagagccctcattccaattccaagctaagaaggtattggggcagaggctccccaaattggggtgatcccccaaggagtgatacatatattgtgtatatatttacagctgtattgtaaaagtggggtccctgtccccagctgctcctggggagtagaagcaataatgtatttctaatttgtgggtcccacttcggctatgcgggtttctagggggtgggggcttgggaccaaagccttgccccgcccctatgccccttgggggttttggctgtgtaagggggtgaaggactgcccctcccttccgagacccctccttcctggtttctgttcctttttcctggcagtgaattatgcaaagggggccggcaaaggaagggtaggtgggggaaagccaggtggaagcttgaaagactgggggactgggcctgtaaggaaggagccatcccagtccccctccgccctgctcccggcgctgagtcatggggtcgtggagaagggggcggggtggcctgattggctcgcctgcccctgggggcagtagaggggccccgcccagctaggggagccgctccgttccactcccctccctagccctccctccccacggccctgggcagggaatgtcttgttcccgccgctccctccccggggccagagggcagggcgggccgggcggcgtcctaccctcttctcctcctccccatctcctccccgcccaggtgcgagccggagccgccgccaccgctgccgcccctgactcacgccgcccccgggctggcgcagcgaagggtgtgggacagggtaaggggttggaagagccttgtggagagcgggcgagccggcgccatctggcggccatgctctgagtgggcgagcgccccccgcggccactggagcgagctgtcttcacgctcctcatccaccccagctggtgagcggcgcccccttgccaaggcagtgggcacagaacttctcgcttggccgcaggggaaggggctgcggagctgtgggaaagtgatccccttcccagatccttgccagccgggcttcctgtcaggcaggggagaataatccccactctgctcttaggattgaatccacccccattctgtacatagcctcttctgttggtcttgttgaaatctagtttcagatttttaactacccaattctgctgggggtgggggacacccccccttcctcgctgggtgctggaccccttttgcagcctgggctctgccttgcactatttccccttcctggcctgacggctcctccccctccttaaaaggggcaggttcaggggcccggtgctcttcctcccttccatgcacccccatgcccatttgcacagctgcccaggtacccctaacagtggggaggggtcacagggagggggtagcgggaccagtccctgttatctatttaaaaagtgatgatgtaatatattggggtggcggggagatcgggttgtcctgggcctcatcttagcatttcaggtgatggggggagcccagggctggggagacctggggcccagccccagaaagtggggacaatgtggcctcccttctccctactttcggctttcccagtcagtgccttagggggagaggcactccccccctcctattcccttccccccaccccaactcccccacctcgggtgtaagcgacaggaagaaataataataatttaagattcaaaaaaa

SEQ ID NO: 32100 - DNA, 3711 bp, Homo sapiens
ggggagggaggggagggatggggggaaagcaagctggaggacaggtgagacagcaggacaggaccggagcagggccccaagcccccgggcctggtgggggacgcgcttcttcccacactgtgagcctcagcagctccagccagcggacccgacggctgagagtgtcctaaccgctttggagagcgataacttgagttaaagcacctgtctgtgcctggcctccagcagatcttggtccagtgagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccgccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagcaggggtctggggcacggagccttgctggcatcagcatcagcccttcctcccagagccctcattccaattccaagctaagaaggtattggggcagaggctccccaaattggggtgatcccccaaggagtgatacatatattgtgtatatatttacagctgtattgtaaaagtggggtccctgtccccagctgctcctggggagtagaagcaataatgtatttctaatttgtgggtcccacttcggctatgcgggtttctagggggtgggggcttgggaccaaagccttgccccgcccctatgccccttgggggttttggctgtgtaagggggtgaaggactgcccctcccttccgagacccctccttcctggtttctgttcctttttcctggcagtgaattatgcaaagggggccggcaaaggaagggtaggtgggggaaagccaggtggaagcttgaaagactgggggactgggcctgtaaggaaggagccatcccagtccccctccgccctgctcccggcgctgagtcatggggtcgtggagaagggggcggggtggcctgattggctcgcctgcccctgggggcagtagaggggccccgcccagctaggggagccgctccgttccactcccctccctagccctccctccccacggccctgggcagggaatgtcttgttcccgccgctccctccccggggccagagggcagggcgggccgggcggcgtcctaccctcttctcctcctccccatctcctccccgcccaggtgcgagccggagccgccgccaccgctgccgcccctgactcacgccgcccccgggctggcgcagcgaagggtgtgggacagggtaaggggttggaagagccttgtggagagcgggcgagccggcgccatctggcggccatgctctgagtgggcgagcgccccccgcggccactggagcgagctgtcttcacgctcctcatccaccccagctggtgagcggcgcccccttgccaaggcagtgggcacagaacttctcgcttggccgcaggggaaggggctgcggagctgtgggaaagtgatccccttcccagatccttgccagccgggcttcctgtcaggcaggggagaataatccccactctgctcttaggattgaatccacccccattctgtacatagcctcttctgttggtcttgttgaaatctagtttcagatttttaactacccaattctgctgggggtgggggacacccccccttcctcgctgggtgctggaccccttttgcagcctgggctctgccttgcactatttccccttcctggcctgacggctcctccccctccttaaaaggggcaggttcaggggcccggtgctcttcctcccttccatgcacccccatgcccatttgcacagctgcccaggtacccctaacagtggggaggggtcacagggagggggtagcgggaccagtccctgttatctatttaaaaagtgatgatgtaatatattggggtggcggggagatcgggttgtcctgggcctcatcttagcatttcaggtgatggggggagcccagggctggggagacctggggcccagccccagaaagtggggacaatgtggcctcccttctccctactttcggctttcccagtcagtgccttagggggagaggcactccccccctcctattcccttccccccaccccaactcccccacctcgggtgtaagcgacaggaagaaataataataatttaagattcaaaaaaa

SEQ ID NO: 32101 - DNA, 3228 bp, Homo sapiens
ggggagggaggggagggatggggggaaagcaagctggaggacaggtgagacagcaggacaggaccggagcagggccccaagcccccgggcctggtgggggacgcgcttcttcccacactgtgagcctcagcagctccagccagcggacccgacggctgagaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccacgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccgccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagcaggggtctggggcacggagccttgctggcatcagcatcagcccttcctcccagagccctcattccaattccaagctaagaaggtattggggcagaggctccccaaattggggtgatcccccaaggagtgatacatatattgtgtatatatttacagctgtattgtaaaagtggggtccctgtccccagctgctcctggggagtagaagcaataatgtatttctaatttgtgggtcccacttcggctatgcgggtttctagggggtgggggcttgggaccaaagccttgccccgcccctatgccccttgggggttttggctgtgtaagggggtgaaggactgcccctcccttccgagacccctccttcctggtttctgttcctttttcctggcagtgaattatgcaaagggggccggcaaaggaagggtaggtgggggaaagccaggtggaagcttgaaagactgggggactgggcctgtaaggaaggagccatcccagtccccctccgccctgctcccggcgctgagtcatggggtcgtggagaagggggcggggtggcctgattggctcgcctgcccctgggggcagtagaggggccccgcccagctaggggagccgctccgttccactcccctccctagccctccctccccacggccctgggcagggaatgtcttgttcccgccgctccctccccggggccagagggcagggcgggccgggcggcgtcctaccctcttctcctcctccccatctcctccccgcccaggtgcgagccggagccgccgccaccgctgccgcccctgactcacgccgcccccgggctggcgcagcgaagggtgtgggacagggtaaggggttggaagagccttgtggagagcgggcgagccggcgccatctggcggccatgctctgagtgggcgagcgccccccgcggccactggagcgagctgtcttcacgctcctcatccaccccagctggtgagcggcgcccccttgccaaggcagtgggcacagaacttctcgcttggccgcaggggaaggggctgcggagctgtgggaaagtgatccccttcccagatccttgccagccgggcttcctgtcaggcaggggagaataatccccactctgctcttaggattgaatccacccccattctgtacatagcctcttctgttggtcttgttgaaatctagtttcagatttttaactacccaattctgctgggggtgggggacacccccccttcctcgctgggtgctggaccccttttgcagcctgggctctgccttgcactatttccccttcctggcctgacggctcctccccctccttaaaaggggcaggttcaggggcccggtgctcttcctcccttccatgcacccccatgcccatttgcacagctgcccaggtacccctaacagtggggaggggtcacagggagggggtagcgggaccagtccctgttatctatttaaaaagtgatgatgtaatatattggggtggcggggagatcgggttgtcctgggcctcatcttagcatttcaggtgatggggggagcccagggctggggagacctggggcccagccccagaaagtggggacaatgtggcctcccttctccctactttcggctttcccagtcagtgccttagggggagaggcactccccccctcctattcccttccccccaccccaactcccccacctcgggtgtaagcgacaggaagaaataataataatttaagattcaaaaaaa

SEQ ID NO: 32102 - DNA, 2437 bp, Homo sapiens
ggggagggaggggagggatggggggaaagcaagctggaggacaggtgagacagcaggacaggaccggagcagggccccaagcccccgggcctggtgggggacgcgcttcttcccacactgtgagcctcagcagctccagccagcggacccgacggctgagaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccaccgctgccgcccctgactcacgccgcccccgggctggcgcagcgaagggtgtgggacagggtaaggggttggaagagccttgtggagagcgggcgagccggcgccatctggcggccatgctctgagtgggcgagcgccccccgcggccactggagcgagctgtcttcacgctcctcatccaccccagctggtgagcggcgcccccttgccaaggcagtgggcacagaacttctcgcttggccgcaggggaaggggctgcggagctgtgggaaagtgatccccttcccagatccttgccagccgggcttcctgtcaggcaggggagaataatccccactctgctcttaggattgaatccacccccattctgtacatagcctcttctgttggtcttgttgaaatctagtttcagatttttaactacccaattctgctgggggtgggggacacccccccttcctcgctgggtgctggaccccttttgcagcctgggctctgccttgcactatttccccttcctggcctgacggctcctccccctccttaaaaggggcaggttcaggggcccggtgctcttcctcccttccatgcacccccatgcccatttgcacagctgcccaggtacccctaacagtggggaggggtcacagggagggggtagcgggaccagtccctgttatctatttaaaaagtgatgatgtaatatattggggtggcggggagatcgggttgtcctgggcctcatcttagcatttcaggtgatggggggagcccagggctggggagacctggggcccagccccagaaagtggggacaatgtggcctcccttctccctactttcggctttcccagtcagtgccttagggggagaggcactccccccctcctattcccttccccccaccccaactcccccacctcgggtgtaagcgacaggaagaaataataataatttaagattcaaaaaaa

SEQ ID NO: 32103 - DNA, 476 bp, Homo sapiens
ggggagggaggggagggatggggggaaagcaagctggaggacaggtgagacagcaggacaggaccggagcagggccccaagcccccgggcctggtgggggacgcgcttcttcccacactgtgagcctcagcagctccagccagcggacccgacggctgagaggagccccagaaccaggactgggggatttggagctgggcagagacttaacccccacagcaccgggaagcagccaactcccctcgcctccttcccccttcgtggcttgcggtctctcttccccgcctcggcccccaggaagtgaagatgttacagcctggtcctcatcctccctcaccccaagctgctgctcctggagaagcctggccaggcccctctcaggctccctggcagagcctagaggtaggggccttggaacctggggagggggggctctgcgtgcctgtgtcccaggcccatatctattttctctgctg

SEQ ID NO: 32104 - DNA, 312 bp, Homo sapiens
ctgttttgctttctagctggtggctttgtgaacaaagcatagcggtacagatatcctcaaataccctcatgtaccttgaagaggtcacttgggtagtaaacccttttggttcccgtgccactaacacaggagcaattgagagcctaaactgggtttgcctcagcaatagaggccagtagtaaaaattcagccgtaaagaccagcagtaagaaaagtagtcaaggtcaggggcaaactatctgctggagtgaaatgtttaaagcttccaatgaggctttaattagattcaaaaaacatcccgctgttaaactg

SEQ ID NO: 32105 - DNA, 397 bp, Homo sapiens
ttttggaaaaaaataagaatagttggagaatgttaaaacattattgaaaaacatatcgactaaaaaagataaaaacaatcccaaatcactttaatactttaaataaattcacaatagaattctactcagtgttaaaatactggagaaggctgggtgcagtggctcatgactgtaatctcaatactttgggagcctgagaccggaggattgcttgagcccaggaattcaagaccagcctcagcaacatggcaataccccatctctacaaaaaaatttttaaaaattagctgggtacagctgggcacagtggctcatgtctgtaatcccagcactttgggtggctgaggtgggtggaccacttgaggtcagttcaagaccagcctggccaacatggtga

SEQ ID NO: 32106 - DNA, 398 bp, Homo sapiens
agtctggcaaggggcgcttggcagatgagagtggaggttgtaaatcaccctccatgcaatggttcatcataaaggatatggagcaaaattagaggaggcacgagaaggaaagccggtgatgaacaaggatttgcctcaactacagagacagcatggaacacgccctcctaggctgcccacatcctcatctgcatgggggcacagaagcctggccattcatcccatgggagactcaggacatgctcccagcaacctgatgggctgcccaaggcttggctgatcctgcatccctgcatcacatctcagcttctccctctgcccaaatctacttcctccccattcctttcacaggcattgattccctgataaacaccttgcaccccaaaaaatccatctca

SEQ ID NO: 32107 - DNA, 431 bp, Homo sapiens
agtctggcaaggggcgcttggcagatgagagtggaggttgtaaatcaccctccatgcaatggttcatcataaaggatatggagcaaaattagaggaggcacgagaaggaaagccggtgatgaacaagaaagtgcctggttgaagctagcttgcaatcccaaagtcagaaggttgcctgggaagccatgaaacaaagcgccaaatcaaggcaaagcagacacatggagattttgagactgagaagaggaaaactgaggacattcatgtgagatggtttcaagtttcccttagaaggagaagttatcttcagaaggtcaggttggtgaggtgggagttcaaaaacaacaaagtatgtagctaccattgtgaggaagaccatggaaaatggacgaatcagaatgaaaggctttctgaacaagagtaagtacccc

SEQ ID NO: 32108 - DNA, 1366 bp, Homo sapiens
atccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagccgccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctgggaccttccctcagccctgctcttcgctgccagcatcctcaccaccacaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttggtggagggacctcactccagggcacggcgtgggaggggtagtcgaagagctctggtggcagcgttgagaaggggttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcaggggatactgttaatcataaaatgagcaacg

SEQ ID NO: 32109 - DNA, 1292 bp, Homo sapiens
atccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagccgccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctgggaccttccctcagccctgctcttcgctgccagcatcctcaccaccacaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttgttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcaggggatactgttaatcataaaatgagcaacg

SEQ ID NO: 32110 - DNA, 1562 bp, Homo sapiens
atccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagccgccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctgggaccttccctcagccctgctcttcgctgccagcatcctcaccaccacaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttggtaagtccagccacctaacagcgtgtgggggaagggggaagaggagcctggactaggactcccataaatcactggggggctgggccttgcaggtggagggacctcactccagggcacggcgtgggaggggtagtcgaagagctctggtggcagcgttgagaagggggtgagtggtgccagttgccagggcaagtcactgcgctgggaggtgggcggggagcatcaccagaacccaggcgctgccccagcaccttctcctccccaggttacttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcaggggatactgttaatcataaaatgagcaacg

SEQ ID NO: 32111 - DNA, 1083 bp, Homo sapiens
ctgacgaagaggagcagagccagctagaacctgggcctggccagttcaaggccaccagagggcagccttctgcggaaggcagtattggggtaggcagggaccccagcagacatggcactcagagctctcactgtccactgactctctcttctccaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttggtggagggacctcactccagggcacggcgtgggaggggtagtcgaagagctctggtggcagcgttgagaagggggtgagtggtgccagttgccagggcaagtcactgcgctgggaggtgggcggggagcatcaccagaacccaggcgctgccccagcaccttctcctccccaggttacttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcaggggatactgttaatcataaaatgagcaacg

SEQ ID NO: 32112 - DNA, 448 bp, Homo sapiens
agtagaaaaaaatatttttattgatttttattttaaaattgtatgtatttattattttttaaagacaggatctcactttattgcccaggctggtctcaaactcgtgggctcaagcgatcctcccatctcagcctcccaagtagctgggattacaggtacgagccaccgcatccagccaaaaaaagctttagcatatatttttttcatgcaaagtcataaatatcccttgaaggatgcaagagccagtatcactgattgcctttgaagaagggaagtgggtgtctgaggggtacagtgtggaaggagatttttccctgctactctttcagactcttggaattttaaaccgtgatcgatgcagtgccctatttaaaaatttaaataagagaaaataatgcgctgtgtattaaattcacatacattaaagcataccctgaataaagaaaca

SEQ ID NO: 32113 - DNA, 362 bp, Homo sapiens
gcaaccaatatttgaaactcctatatataatgattaagatagtggtagaaaaaaatagtccatgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaa

SEQ ID NO: 32114 - DNA, 437 bp, Homo sapiens
tcttaaatgttcttttggtaacatctttgaggaagtcaactctagtcgatattgtcttttcagtgacaaagtgtcaagtaccttataaggtgggcattgtgtcttggatcatttttgtaacaaagttcctctttcctttgagctacatttggtgatccagagttttctactctttctccctgcttctattctttttgctagtacaaaacaatctgtagacaagacagctaacagttcctccaagtaatttcttaacaataaaaaatgaacacctcccagcgttcctgaaatcattccttatatgtctctgattcaagcacttttaccagggtatcctgtaggtactattctgtccccacccacatcagggagacactggaatatgatagcattgagtcacctaatttcagaatcagcctagtctgctcagtgtgttg

SEQ ID NO: 32115 - DNA, 314 bp, Homo sapiens
tacctgcatccatgtcctgctttgatttctcttcgctttccctcctgtgtcctcccccttccaactcttttcacagtacccttgaagtttgcctgttcatgccagcgaaccctcacagttttagtctctttatagagttccttccctatcttctgccctaattgaaacttggtctcccctacttgttggaagtcctcttaatggtcttctaagacatgtaaagtctcaccctaaatttggagctatgtgactttttcttatatcccacattactgttccaaaatgttattcttcctgcaattcaacatttatct

SEQ ID NO: 32116 - DNA, 497 bp, Homo sapiens
gcgtgagccaccgcgcccggccgcattctctgtcttttcactttctaatatttaaaagaggcagctcaaggccacacttacccccttttagtgtccattttaatctttccttggtctgtagtgcacagatttagtagactccaatatttcaaataatggccccatgccccaagtgttttccttacagctctgtagacatcatgtggtaaaacaaaaacattaaaagcattcagaaaccaaacaaaacagaatagctttggtgttaccatttatacttcatttgaattactggatactagttctttgtagacatttggaggtttctccgtaaagtcctgataagaattttcagaaaaggaaggcatagctcttaggtgactgagtatattggggagtagtgtggattggtgacacaatagagtgctttacagagctagaggggatcattacagtgaagtatttctgagcaaggataggcatcaaaaatagggatggaa

SEQ ID NO: 32117 - DNA, 387 bp, Homo sapiens
gagtgtctaccacatgccaggaatgttcatctgtgctattttatcttcccaaatagataagatggttgagatgattgtctcattaatatctgaagacacaggctaagagaagttaagcaatttgtccaaagactcacagctgggtaatggtggagccacgactccaaacccacccctgcctcctagcatccagtctcttatgtcccatggggcttctcagtcagggactcctcctcctctcccttcttgaaagacaccttcttgaatccctggaccaaagatgcttccagaaatggtagttgaggtttcttggccccctttgaggagaggattaggcggctctttcacctgctgccttaagtacctgctctgggcatgtggatggac

SEQ ID NO: 32118 - DNA, 415 bp, Homo sapiens
aaaaccatgactcttgtgcctgacttcccatttagtctgatgagattgggagaacaatgccagattgattcattttgtttttaattgtcgtaaagaccattgaggggtgaggagaatgttgtttgaatttgacattttgaactgggaaacagcttggaaatgtaggcacaattccaggtaaataaactaaatatacttatgtgtgtatgtatatgtaagtctaattgcttaaaggtatacctctaagattccaaattgattgatgctagaaggcagctgtttgaggaccagaggcatggcttatatgcaaaatgatatggaaaaaaaataattggatcacagaaagacagtattatttaatcagaatttgaaatctggcagctctcctaggagaataaaatactattggattgca

SEQ ID NO: 32119 - DNA, 238 bp, Homo sapiens
tatataaaaacattgctgctattgcttgaactctttgggagagagagagagagagagagagagagtgtgtgtgtgtgtgtgtgtgtgtgtgtgtgaagttacttactgggtactatgtacattatttgggtaatgaaagcactgaaagtctaaacttcaccactatgcagtatacccaggtaacatcattgcacctgtaatctttaaatttacacaaataaaaagtaatagttggatt

SEQ ID NO: 32120 - DNA, 406 bp, Homo sapiens
tgagacgtagcctcactttgccgcccaggctggagtgcagtggcacgatctcagctcactgcaagccccgcctcccaggttcacgccattctcctgcctcagcttcccgagtagctgggactacaggcgtgagccactgtgcccagcgaaagtgattcttaatcttagtgaaattctgaaatacttgataattctttaaaagctgtctggttaagagtagaaaggaaatggttattgaatcagatagaccagttctgttgagggtcttaaagagtctcaattttctcatctataaaaccaatacctttccctcctggggctagtaagatttttttttttttttttttttttttgagacagagtctccactctgttgcccaggctggagtgcagtggtgcaatatcg

SEQ ID NO: 32121 - DNA, 274 bp, Homo sapiens
gcttagcttcaactttctcactttctcacggaacatttcattttggaatccacccatcaggctgtaagaagcccaggtcacatggagaggtcataaccaaggaaaacactgaccatccagcagacagtcaactccaactgccagccacgtgagtcagtcatcttcaacttcctagcccagtctaacctttgaataactgcagtcaagtcagcactatttggagatttgaaattctacattcaactaacctttaagaatcatcacacaacaaatt

SEQ ID NO: 32122 - DNA, 179 bp, Homo sapiens
tatgagagaggcttagcttttctctttcaaaggaaaccatcatttttctaaataaaccctactggtttgatgctcttttctctacttgaaacacattttctccctcctacccgagcaggatatttgcagtggagtgattctggtttctctttgttctccctgtctgacatgcctttgat

SEQ ID NO: 32123 - DNA, 609 bp, Homo sapiens
ggcctcaaaacttcacacagcaaatttatctagcagtggcatgcagggtaggttgagggttgagcaaggaggtcagttagcaaattcttcaggagtgaggtgatgggagtcttgttctaaagtggcgagaatggagaggaaacatgagagctgttggttgggccattgttcaggcagctgttgccatgtgtctgtttatttctctgtgcacttgggttaatctgtgatgaccatttaaggtgcagactcctggtgtgtggcagtggttctgtatggcgaattgggcaggtgccaagagggaattcataatccatcgctgacattatggagtacttacagtgggccacacatcctatgctaagtcctgaattacctctttcattcctcaccataactcagtgaggtatctgccattattctccctcttttacagacgagggaaccaaggctcagtgagcttcagtaatttgccacaagtcacacaactaggattcaaacccaagtctgtctgaccgcaaggtctttaaccatcatgtatactgcccgcctcattattgattgatagtaatgactgtttatagcatctttctcatgtttcttccttattta

SEQ ID NO: 32124 - DNA, 162 bp, Homo sapiens
attgctattaagtatttgttttgatcttgaaacttcatgtacacagaagggctttttgactacatttgaatttagaaaatataaaagtattagtgaaagcaaatttttaaggtctattttaagctctgttatatgttagttattaatagatttcacctatta

SEQ ID NO: 32125 - DNA, 471 bp, Homo sapiens
gcgggcggatcacgaggtcaggagatcaagaccatcctggctaacatggtgaaaccctgtctctactaaaaatacaaaaaaacacaatagctaacttcctatagcgtttttgagtataattacttacattattaaataagtttttttgatcagttaaagcactatttatgtactaaaaatcaagaggaaaagtagttctgctgtttgggaagagactattaaatcatttagattctaaatgaaatatgctttatgcagttaagaaagggagggagtgatgatactcatgttaactgagaggtatagcaggtcgtagactaagtacttaaaatgcttcatcttcaagaatcctcattaccctatttaatattctttttacaagtgagagaaacagatttgtctggcagagcatgagacagaatagcaggagagttacttgccaggtctaatctccatgtttgaataatacct

SEQ ID NO: 32126 - DNA, 434 bp, Homo sapiens
ttttcagtgaacccagatcacgccattgcactgcagcctaggcaacagagagagactccatctcaaaaaaaaaaaaaaagaaagaaagaaaaaagaacattttttacttatataattaatgaagttaactttcatttgagaaagacatcttagctcagatgggtcaaatccctaaaatcacttccccttcggaacttttcataaaagtcctgagagtcactcagcaacatgggtgcttgatacgcaaccttgaagactttgcgatgtccgggtagaatttcgccttaaccaactaatgaatgaaaacttaaaataactttttgttcttattccacaacgttaccacttttttaggagagctggtaaccaaagtgaatgatgtctgtagaccagtagttcctacacctaggtacaaattgcagttatctatggag

SEQ ID NO: 32127 - DNA, 1732 bp, Homo sapiens
  misc_feature (185)..(185): n is a, c, g, or t
ttaagtgaaggaatatgacacagaattttatgtatagagttccagatatcctgctcactacagactgaaattccatgcagtctaatagatgaatcagagcgtttccgtcttgtctgggtagtccctgggttccctttttggagggatttgtttttagataattataaattggtccaacagtgtantttcagtgcctcctacctccctctaccaagtatgaactgcatgcatggctaatgtatgatttcagctattattgcttcatttgcattgttcagtattttgtaattgttattaaaataaaaaactgacttggaacatgaattttaaaatggtgttttatccttctagtattgattaccacttttagaaaaattggtgtcatccagtgagttttatacagaaggattttttctcttatacatacatacatacatacatacaaaaaaaatttgtcatttgccctgtggttgttcattatgctgtagactttgaggttaaatagtcttttctctctagtatgggtttatcttctagaaacgataaaggattttctgttgcttaaaaacaagatttaaaaactaaatttgttgatgaaaagaccagccaatataaaactaaatggacagaggaaaaaattcaaccagaatgtaatatacatgtgaactaaatgttttctgttgctgacattttgtaggcttctgaaatttaatgggacttttacaaggtttaccttttttcctaaagtttaatttttaaactgacttaaatgttctttgaccctttggttatatttaagaagttgacttccctaatttccttgttatgtttatttttaaatatctttctttctagaagttgggatattataataaatactcagcaagtattgttttgcatttaaatataaaatcttgttatttggattttaatagtttatattaaatgcccttaagatttattaaaattttggattaactgaactctgcttttttgtcactggattgataagcaggcttatatctgacataacagcttaataaggtagtggcagtttaaatttgtcatgaatatgaattgaaaaaccataacaatttagaaatctgagattgaatatttcatggcatttatatttagtgttttatataatgattaatgaaaagaagcaaaacttaaaattttttttcaaaaatggataggttcaggccagatgcaatggcttacgcctgtaatcccagcactttggggaccaaggcaggaggaccattgcttgaggccacagactaggcaacatagtgagatcccatctctacaaaaaattaaaaagttagttgaggctgggcgcagtggctcacacctgtaattctagcactttgagaggctgaggcaggtggatcacctgaggtcaggagttcaagaccagcctggccaacatggtgaaacctcgtctctactaaaaatacaaaaattagccaggcttggtggtggatgcctgtaatcccagctactcaggaggctgaggcaggagaattgcttgaacccgggaggcggagattgcagtgagccaagattgtgccactgcactccagactgagcaataagagtgaaactaaaaaaagaaaaaaaaattagctgggcctgggggtgcactctgtagtcctagctacccaggagtcaaagtggaagaattggaggctatggtgagctatgactacaccactgcactccagcc

SEQ ID NO: 32128 - DNA, 600 bp, Homo sapiens
atcctttttaactaactcaggaaataaggtattatgaaatccacacactgttacctccttaaagtatgaggatacttcccactgtttggtccactagtggctgattattttgtttgtggattatttgtaattttctttttaattcttccttaaagagcatggcatttggagtcacagacctatatttgaatcctgtcatttactagcgttttgaccttgaacaattatgctcagagtctcagttttttcttgtaaagtgatgatgatactacttaactcacagggttgtagtgaagatcaaatgagatcatgtctgtagaacaccctgcccggcactcaataagtattaataggaacccatatacctcttttgaaaattttaattgtcagacaaataaaaaaaaaagccagtgctttgtaaatattcgtgaatatttagtgttcattctgtttttttgtcatgatggagagagagttgggtttctgtgaattactgttacagctttacattaatatttttaaatcactttttgggtatgaagaatttcaaatgaaaggtgatagagtagtatagtgaatcctcatgtactcatcagtcgg

SEQ ID NO: 32129 - DNA, 1044 bp, Homo sapiens
ctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgcgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaactttttccgttatcacccaggcctgattcactggcctggcggagatgcttctaaggcatggtcgggggagagggccaacaactgtccctccttgagcaccagccccacccaagcaagcagacatttatcttttgggtctgtcctctctgttgcctttttacagccaacttttctagacctgttttgcttttgtaacttgaagatatttattctgggttttgtagcatttttattaatatggtgactttttaaaataaaaacaaacaaacgttgtcctaaaaaaaaa

SEQ ID NO: 32130 - DNA, 378 bp, Homo sapiens
ccaataatcttaatactgtagaccttcaagtcttcctgagtgtacctgttggttgtgcccttttagaagtatgctctttcaaaagtatgtttcttggctgggcgtggtggctcacatctgtaatcccagccctttgggaggcctaggcgggtggatcacttgaggtcaggagtttgagaccagcctggccaacatggcgaaaccccgtctttactaaaaatacaaaaaatagccgggcctggtgacatatgcctgtaatcccagctactcgagaggctgaggcaggagaattgcttgaacccaggaggcagaggttgtagtgagccgagatcgcgccattgcactccagcctgggcaacagagtgagactcaaaaaaa

SEQ ID NO: 32131 - DNA, 391 bp, Homo sapiens
  misc_feature (14)..(14): n is a, c, g, or t
  misc_feature (101)..(101): n is a, c, g, or t
ctcgcacacgcgcngtgttcgtgtggaagtcgttgcccaggcgcgtgtagtacttttctatgatgacccgggccgccttcttcacggttttggtgcgaacnggcccatgttggcgggtccttggtaaaagaactgctcaagatcccattgcttttttttttttttttgtaatagtgcgtgtttatattcaggagtgcttaatccaagaacctgtgatttctgctcttgttttacctcctatgaacgaaaaattgttgtccttacggttttttctgctttctttgaaatgttccttacagaataactacatgaatgtaatcacatgcatttaaaatagtctagagaatatagtgtgaaactataatggtatttttttagatgaggtttctgg

SEQ ID NO: 32132 - DNA, 258 bp, Homo sapiens
gagtgaagtggcagcaaggaaatgggcaaactggaaaggaacgctgaaggtagtccggcgaggctgagtgatggacggaatgggtgagggaagagcaggccagcggcaaccctcagtcaccttcctcacgggtgcgtcgagatgaaggagccgagagtcatcgggccaggagacccggagcagcgctgggagtgctacgcacgcattccttatgttcaaaggccgagtgcagctcattactgctgaccctgaaactgc

SEQ ID NO: 32133 - DNA, 265 bp, Homo sapiens
aaaatcaggaaaaagtaatctcttataaaatgaataacagactacttaaaagtgtacctttattttgtagttgttaacatttccagatttaaagagaatattgcattttatgagacacttaggagaacacaaaaagtgctctttaatgttattgaaagatgtatattcaaaatatcttggaatgaatttcaagaaaagcaacagatcgtagtgtttacatgatttacaatctctcagcagatttcaactaattaatagctaatat

SEQ ID NO: 32134 - DNA, 410 bp, Homo sapiens
tctacagtatgaaaggtgtttttggaaagtagtgctaaaattataaaaggagcctcaaatttgactttctgttccataaagtttctgccatccccaatctgaaccccagccttccctgcagacagcaattggcatccccgctcccttctctcagctatcttaggcagatgcagaacaaacaagagaaagacatcttcaaacaggcattaaacaaggcagtgctatcgtttcttcaagggccaaggtcttgtttagggctcaaggagcttctattccactgagacctcctaggctggggctctcatagtgttaccaaggagaccattggcttgttagggaagaactcagcagcctccattatctcctaaagtcttgcaccttgtttcatgagcaattaaaaatgaaaacac

SEQ ID NO: 32135 - DNA, 330 bp, Homo sapiens
agtacatggtatttggccacatttcaaatgggtgatagtgaacattcactgaagtgtcatagatggctcttatttgccaggtcaaatcttctttgcgagaaagtctcagccaactgttgtcaagcatttctggtggttcctagatacatgaacaaaacctcactagactggtttactgagagcagaattaaaaacacccgggtgccaggttattaaaaacatttttacatttttacatttatggaaaaaaaaatgtgatgtggtgtgtggcttggtttgaatacatcttcactgagctaagtagctgattgaatttacctaacctgaagg

SEQ ID NO: 32136 - DNA, 357 bp, Homo sapiens
taaaattgcagctgttactgaataagcaggataggtttaaaatttggcctccataattaaattcaccttaatgaatatttttagaaaaacggcattctttttcagagtgtcaccttgaagacatgtgtttattctttttttaaattttcccaaaatagctgctatgctccttgaaagtctaggggtaagcattttttatttgctatgtattctttatgtgattatttaaaattagtgtataaaaatggttttcttgataaatgtggcttatctaaattagtgttaagttttcttattgtgtttacatgacatattttttgacagtaacagctaccttttacggtccgctaggtcgca

SEQ ID NO: 32137 - DNA, 3825 bp, Homo sapiens
gtgcgctggtgaggtggcgtccgttctacccggtcgctcccgttccgcgccatgcagagcccagtctctggcacctggctgctctgatctggtctcagcgcggagggagcagagggagtccatggaggatccctccgagcccgaccggttggcgtccgcggacggcgggagcccggaggaggaggaggatggggagcgggagccgctgctaccgcggatcgcctgggcccacccgcggagaggcgccccaggcagcgccgtgaggctgctggacgctgccggggaggagggcgaggccggcgacgaggagctgcccctcccgcccggggacgtgggggtctcccggagttcgcccgccgagctggaccggagccgccccgcggtttcagtaactattggtacttcagagatgaatgcattcttggatgacccagaatttgctgatattatgctgagagcagagcaagcaatagaagttggaatttttccagaaagaatctctcaaggttcaagtggaagttactttgtgaaggatcctaagaggaaaattattggtgtgtttaaacccaaatcagaagagccttatggtcaactcaatccaaaatggaccaaatatgtccataaggtctgctgcccttgctgctttggccgaggctgcctgattcctaatcaggggtacctttccgaagcgggtgcctatcttgtggacaacaagcttcatctgagcattgtacctaaaacaaaggtggtttggcttgtcagtgagacatttaactataatgcgattgaccgtgcaaaatcaagaggcaaaaagtatgctttagaaaaagtgccaaaagtgggtagaaagtttcataggataggactccctcctaagattggttcctttcagttatttgttgaaggttacaaggaggctgaatattggcttaggaaatttgaagctgaccctttgcctgagaatattagaaaacaatttcagtcacaatttgaaagattagttattttggattacatcatcagaaatacagacaggggcaatgataattggttagtcagatacgaaaagcagaaatgtgaaaaggaaattgaccataaggaatcaaaatggattgatgatgaagaattccttattaaaatagctgcaattgataatggtctagcatttccttttaaacatcctgatgaatggagagcatatccatttcactgggcttggcttcctcaagcaaaagttcccttttctgaagaaataagaaatttgattctaccatatatttctgacatgaactttgtgcaagatttatgtgaagatctctatgaactttttaagactgacaaaggatttgacaaagccacttttgaaagtcagatgtctgtgatgaggggtcagatcttaaaccttactcaggcattgagagacgggaagagtcctttccagctagtacagataccttgtgtgattgtggaacgcagtcaaggtggaagtcagggtcggattgtccacctgagcaattcctttacccagactgtcaattgcaggaagccatttttttcctcctggtagtaaatgtcagagtaagagaaacaaactgtttagaattatcatgtttttaaaacatcatagtaatataaatctgctgttaggagctccagttgctaaaacctcaatttaagtctttaaaaggttgtattttgaatgtaaccaaaagtttacagttttttgtccaaatattaaatttctatttcagggaagaagtgctatatctcctatattgtatttttgtagaaaatttgtattttatgttgttgttagtttaaaaggtaattttacacatgctggaatgactgtaattactctagaattccaagtagaatacaataacttttaatattgagaagaatgttcatgctaattcttcttacattacaaaaggcctttgaggatgcctacgtctgaaattgctcttacgaactttaataaaatagttagctaatagaaaaacaggtaagaataaagcaatgttgccttaatttcaaaagctgctattttagaatttgaataagtactcctaaagtgaccattattagggaccagaaaattatatcttggctaagtaatagaggaccattttggtttttgtacttgagaatatttttggtgaattactttgttgtagtgaggaaaaaacctaagaaatttcccctttttttaaaaaatggaaatattcaattgagacttgaggggaataatagaaaattaaggtagatccccaatattttggaataccaaaattgccttaaaaattcccttctgtttcttacatgggatcaaatacttgagattagtacttcagagtactggccttgttcaatttagtacttcaattagtattaaacttcactaaaaagtaaaccatactccaaattgtatattggattgcattttggggtcctaggtcatacgttcttcaaaattattatgattgtactattgtacttgaaattacagatgttattataattacagtcaaatgtagactatcaggccaaattaaaggggagcatggcagataaccataaagtcatttatatttgattttgaaatgtatttttgtactttattttgaatatcatccatatgtctgacattattggaatttgtaacattgttaatgcactaagtgatttaaattcaattgatgaagatgtgattttacagaagcagaagtttcattttcttgaggcttaaaaccaatgtcaccacttgggcttaactgggtaatttgtggtctaggccttttgttttctaagcttactatcttgtgtttgtttatttgcttttaatgaagtattttgtgtagaaggttaaattaggatgcaaaacagatctgccattcctttttcccttatatcttccttttggtcttcatggacgagatgaatgaggattctgctgccctgagggagttcattggaaacctgcgttctcctacctcttccaaccctccattagctcaattttgagataatggaaaattgactggaaattcaaaactcaaactactatctttagatataaacactagtaattaaaatgtgccttttgaagatgttttctaagagaaaggaaatacgttgcagtgatgtgggtactgctttcataaaacagttttttcagtattttgagaattgccatattaatttttataatggaaaacttaataaattgctactgttttatatcataaaattaaaataccatggtaatatttgcaaaaggtctggccataccagaaaagtacagttgagatagttaagatataaccacaagtcagagtacattggttgtattttgtaaactttcatgaactgaattcttatttaaatagtatggttttttttcaataagtatatttatagtgacaaatgtggtagactaaaggtaataaaaatcattgtcttaagattatgttcttctgtatgtacgtgtttggaatatttagaatgtttatgaacacatttactataaatgatgccaaactatcattttcttcatatattaaaggtatagtttaattctttttttttttttttttttgagacggagtctcactctgtaatcccagctactcaagaggctgaggcacaagaattattgaacccaggagggagggtggaggttgcagtgagccgagatcacaccactgccttccagcctgggtgacagagtagattctgtctcaaacaaacaaacaaacaaacaaacaaaaaaattgaagtactgtactatatggaattaaaaccttttttaaaaatgacggt

SEQ ID NO: 32138 - DNA, 3466 bp, Homo sapiens
gtgcgctggtgaggtggcgtccgttctacccggtcgctcccgttccgcgccatgcagagcccagtctctggcacctggctgctctgatctggtctcagcgcggagggagcagagggagtccatggaggatccctccgagcccgaccggttggcgtccgcggacggcgggagcccggaggaggaggaggatggggagcgggagccgctgctaccgcggatcgcctgggcccacccgcggagaggcgccccaggcagcgccgtgaggctgctggacgctgccggggaggagggcgaggccggcgacgaggagctgcccctcccgcccggggacgtgggggtctcccggagttcgcccgccgagctggaccggagccgccccgcggtttcagtaactattggtacttcagagatgaatgcattcttggatgacccagaatttgctgatattatgctgagagcagagcaagcaatagaagttggaatttttccagaaagaatctctcaaggttcaagtggaagttactttgtgaaggatcctaagaggaaaattattggtgtgtttaaacccaaatcagaagagccttatggtcaactcaatccaaaatggaccaaatatgtccataaggtctgctgcccttgctgctttggccgaggctgcctgattcctaatcaggggtacctttccgaagcgggtgcctatcttgtggacaacaagcttcatctgagcattgtacctaaaacaaaggtggtttggcttgtcagtgagacatttaactataatgcgattgaccgtgcaaaatcaagaggcaaaaagtatgctttagaaaaagtgccaaaagtgggtagaaagtttcataggataggactccctcctaagattggttcctttcagttatttgttgaaggttacaaggaggctgaatattggcttaggaaatttgaagctgaccctttgcctgagaatattagaaaacaatttcagtcacaatttgaaagattagttattttggattacatcatcagaaatacagacaggggcaatgataattggttagtcagatacgaaaagcagaaatgtgaaaaggaaattgaccataaggaatcaaaatggattgatgatgaagaattccttattaaaatagctgcaattgataatggtctagcatttccttttaaacatcctgatgaatggagagcatatccatttcactgggcttggcttcctcaagcaaaagttcccttttctgaagaaataagaaatttgattctaccatatatttctgacatgaactttgtgcaagatttatgtgaagatctctatgaactttttaagactgacaaaggatttgacaaagccacttttgaaagtcagatgtctgtgatgaggggtcagatcttaaaccttactcaggcattgagagacgggaagagtcctttccagctagtacagataccttgtgtgattgtggaacgcagtcaaggtggaagtcagggtcggattgtccacctgagcaattcctttacccagactgtcaattgcaggaagccatttttttcctcctggtagtaaatgtcagagtaagagaaacaaactgtttagaattatcatgtttttaaaacatcatagtaatataaatctgctgttaggagctccagttgctaaaacctcaatttaagtctttaaaaggttgtattttgaatgtaaccaaaagtttacagttttttgtccaaatattaaatttctatttcagggaagaagtgctatatctcctatattgtatttttgtagaaaatttgtattttatgttgttgttagtttaaaaggtaattttacacatgctggaatgactgtaattactctagaattccaagtagaatacaataacttttaatattgagaagaatgttcatgctaattcttcttacattacaaaaggcctttgaggatgcctacgtctgaaattgctcttacgaactttaataaaatagttagctaatagaaaaacaggtaagaataaagcaatgttgccttaatttcaaaagctgctattttagaatttgaataagtactcctaaagtgaccattattagggaccagaaaattatatcttggctaagtaatagaggaccattttggtttttgtacttgagaatatttttggtgaattactttgttgtagtgaggaaaaaacctaagaaatttcccctttttttaaaaaatggaaatattcaattgagacttgaggggaataatagaaaattaaggtagatccccaatattttggaataccaaaattgccttaaaaattcccttctgtttcttacatgggatcaaatacttgagattagtacttcagagtactggccttgttcaatttagtacttcaattagtattaaacttcactaaaaagtaaaccatactccaaattgtatattggattgcattttggggtcctaggtcatacgttcttcaaaattattatgattgtactattgtacttgaaattacagatgttattataattacagtcaaatgtagactatcaggccaaattaaaggggagcatggcagataaccataaagtcatttatatttgattttgaaatgtatttttgtactttattttgaatatcatccatatgtctgacattattggaatttgtaacattgttaatgcactaagtgatttaaattcaattgatgaagatgtgattttacagaagcagaagtttcattttcttgaggcttaaaaccaatgtcaccacttgggcttaactgggtaatttgtggtctaggccttttgttttctaagcttactatcttgtgtttgtttatttgcttttaatgaagtattttgtgtagaaggttaaattaggatgcaaaacagatctgccattcctttttcccttatatcttccttttggtcttcatggacgagatgaatgaggattctgctgccctgagggagttcattggaaacctgcgttctcctacctcttccaaccctccattagctcaattttgagataatggaaaattgactggaaattcaaaactcaaactactatctttagatataaacactagtaattaaaatgtgccttttgaagatgttttctaagagaaaggaaatacgttgcagtgatgtgggtactgctttcataaaacagttttttcagtattttgagaattgccatattaatttttataatggaaaacttaataaattgctactgttttatatcataaaattaaaataccatggtaatatttgcaaaaggtctggccataccagaaaagtacagttgagatagttaagatataaccacaagtcagagtacattggttgtattttgtaaactttcatgaactgaattcttatttaaatagtatggttttttttcaataagtatatttatagtgacaaatgtggtagactaaaggtaataaaaatcattgtctta

SEQ ID NO: 32139 - DNA, 3771 bp, Homo sapiens
gtgcgctggtgaggtggcgtccgttctacccggtcgctcccgttccgcgccatgcagagcccagtctctggcacctggctgctctgatctggtctcagcgcggagggagcagagggagtccatggaggatccctccgagcccgaccggttggcgtccgcggacggcgggagcccggaggaggaggaggatggggagcgggagccgctgctaccgcggatcgcctgggcccacccgcggagaggcgccccaggcagcgccgtgaggctgctggacgctgccggggaggagggcgaggccggcgacgaggagctgcccctcccgcccggggacgtgggggtctcccggagttcgcccgccgagctggaccggagccgccccgcggtttcagtaactattggtacttcagagatgaatgcattcttggatgacccagaatttgctgatattatgctgagagcagagcaagcaatagaagttggaatttttccagaaagaatctctcaaggttcaagtggaagttactttgtgaaggatcctaagaggaaaattattggtgtgtttaaacccaaatcagaagagccttatggtcaactcaatccaaaatggaccaaatatgtccataaggtctgctgcccttgctgctttggccgaggctgcctgattcctaatcaggggtacctttccgaagcgggtgcctatcttgtggacaacaagcttcatctgagcattgtacctaaaacaaaggtggtttggcttgtcagtgagacatttaactataatgcgattgaccgtgcaaaatcaagaggcaaaaagtatgctttagaaaaagtgccaaaagtgggtagaaagtttcataggataggactccctcctaagattggttcctttcagttatttgttgaaggttacaaggaggctgaatattggcttaggaaatttgaagctgaccctttgcctgagaatattagaaaacaatttcagtcacaatttgaaagattagttattttggattacatcatcagaaatacagacaggggcaatgataattggttagtcagatacgaaaagcagaaatgtgaaaaggaaattgaccataaggaatcaaaatggattgatgatgaagaattccttattaaaatagctgcaattgataatggtctagcatttccttttaaacatcctgatgaatggagagcatatccatttcactgggcttggcttcctcaagcaaaagttcccttttctgaagaaataagaaatttgattctaccatatatttctgacatgaactttgtgcaagatttatgtgaagatctctatgaactttttaagactgacaaaggatttgacaaagccacttttgaaagtcagatgtctgtgatgaggggtcagatcttaaaccttactcaggcattgagagacgggaagagtcctttccagctagtacagataccttgtgtgattgtggaacgcagtcaaggtggaagtcagggtcggattgtccacctgagcaattcctttacccagactgtcaattgcaggaagccatttttttcctcctggtagtaaatgtcagagtaagagaaacaaactgtttagaattatcatgtttttaaaacatcatagtaatataaatctgctgttaggagctccagttgctaaaacctcaatttaagtctttaaaaggttgtattttgaatgtaaccaaaagtttacagttttttgtccaaatattaaatttctatttcagggaagaagtgctatatctcctatattgtatttttgtagaaaatttgtattttatgttgttgttagtttaaaaggtaattttacacatgctggaatgactgtaattactctagaattccaagtagaatacaataacttttaatattgagaagaatgttcatgctaattcttcttacattacaaaaggcctttgaggatgcctacgtctgaaattgctcttacgaactttaataaaatagttagctaatagaaaaacaggtaagaataaagcaatgttgccttaatttcaaaagctgctattttagaatttgaataagtactcctaaagtgaccattattagggaccagaaaattatatcttggctaagtaatagaggaccattttggtttttgtacttgagaatatttttggtgaattactttgttgtagtgaggaaaaaacctaagaaatttcccctttttttaaaaaatggaaatattcaattgagacttgaggggaataatagaaaattaaggtagatccccaatattttggaataccaaaattgccttaaaaattcccttctgtttcttacatgggatcaaatacttgagattagtacttcagagtactggccttgttcaatttagtacttcaattagtattaaacttcactaaaaagtaaaccatactccaaattgtatattggattgcattttggggtcctaggtcatacgttcttcaaaattattatgattgtactattgtacttgaaattacagatgttattataattacagtcaaatgtagactatcaggccaaattaaaggggagcatggcagataaccataaagtcatttatatttgattttgaaatgtatttttgtactttattttgaatatcatccatatgtctgacattattggaatttgtaacattgttaatgcactaagtgatttaaattcaattgatgaagatgtgattttacagaagcagaagtttcattttcttgaggcttgttttctaagcttactatcttgtgtttgtttatttgcttttaatgaagtattttgtgtagaaggttaaattaggatgcaaaacagatctgccattcctttttcccttatatcttccttttggtcttcatggacgagatgaatgaggattctgctgccctgagggagttcattggaaacctgcgttctcctacctcttccaaccctccattagctcaattttgagataatggaaaattgactggaaattcaaaactcaaactactatctttagatataaacactagtaattaaaatgtgccttttgaagatgttttctaagagaaaggaaatacgttgcagtgatgtgggtactgctttcataaaacagttttttcagtattttgagaattgccatattaatttttataatggaaaacttaataaattgctactgttttatatcataaaattaaaataccatggtaatatttgcaaaaggtctggccataccagaaaagtacagttgagatagttaagatataaccacaagtcagagtacattggttgtattttgtaaactttcatgaactgaattcttatttaaatagtatggttttttttcaataagtatatttatagtgacaaatgtggtagactaaaggtaataaaaatcattgtcttaagattatgttcttctgtatgtacgtgtttggaatatttagaatgtttatgaacacatttactataaatgatgccaaactatcattttcttcatatattaaaggtatagtttaattctttttttttttttttttttgagacggagtctcactctgtaatcccagctactcaagaggctgaggcacaagaattattgaacccaggagggagggtggaggttgcagtgagccgagatcacaccactgccttccagcctgggtgacagagtagattctgtctcaaacaaacaaacaaacaaacaaacaaaaaaattgaagtactgtactatatggaattaaaaccttttttaaaaatgacggt

SEQ ID NO: 32140 - DNA, 1617 bp, Homo sapiens
gtgcgctggtgaggtggcgtccgttctacccggtcgctcccgttccgcgccatgcagagcccagtctctggcacctggctgctctgatctggtctcagcgcggagggagcagagggagtccatggaggatccctccgagcccgaccggttggcgtccgcggacggcgggagcccggaggaggaggaggatggggagcgggagccgctgctaccgcggatcgcctgggcccacccgcggagaggcgccccaggcagcgccgtgaggctgctggacgctgccggggaggagggcgaggccggcgacgaggagctgcccctcccgcccggggacgtgggggtctcccggagttcgcccgccgagctggaccggagccgccccgcggtttcagtaactattggtacttcagagatgaatgcattcttggatgacccagaatttgctgatattatgctgagagcagagcaagcaatagaagttggaatttttccagaaagaatctctcaaggttcaagtggaagttactttgtgaaggatcctaagaggaaaattattggtgtgtttaaacccaaatcagaagagccttatggtcaactcaatccaaaatggaccaaatatgtccataaggtctgctgcccttgctgctttggccgaggctgcctgattcctaatcaggggtacctttccgaagcgggtgcctatcttgtggacaacaagcttcatctgagcattgtacctaaaacaaaggtggtttggcttgtcagtgagacatttaactataatgcgattgaccgtgcaaaatcaagaggcaaaaagtatgctttagaaaaagtgccaaaagtgggtagaaagtttcataggataggactccctcctaagattggttcctttcagttatttgttgaaggttacaaggaggctgaatattggcttaggaaatttgaagctgaccctttgcctgagaatattagaaaacaatttcagtcacaatttgaaagattagttattttggattacatcatcagaaatacagacaggggcaatgataattggttagtcagatacgaaaagcagaaatgtgaaaaggaaattgaccataaggaatcaaaatggattgatgatgaagaattccttattaaaatagctgcaattgataatggtctagcatttccttttaaacatcctgatgaatggagagcatatccatttcactgggcttggcttcctcaagcaaaagttcccttttctgaagaaataagaaatttgattctaccatatatttctgacatgaactttgtgcaagatttatgtgaagatctctatgaactttttaagactgacaaaggatttgacaaagccacttttgaaagtcagatgtctgtgatgaggggtcagatcttaaaccttactcaggcattgagagacgggaagagtcctttccagctagtacagataccttgtgtgattgtggaacgcagtcaaggtggaagtcagggtcggattgtccacctgagcaattcctttacccagactgtcaattgcaggaagccatttttttcctcctggtagtaaatgtcagagtaagagaaaaccaggctgcaggagaaaaccagctcaga

SEQ ID NO: 32141 - DNA, 1545 bp, Homo sapiens
  misc_feature (1519)..(1519): n is a, c, g, or t
  misc_feature (1521)..(1521): n is a, c, g, or t
  misc_feature (1528)..(1528): n is a, c, g, or t
gtgcgctggtgaggtggcgtccgttctacccggtcgctcccgttccgcgccatgcagagcccagtctctggcacctggctgctctgatctggtctcagcgcggagggagcagagggagtccatggaggatccctccgagcccgaccggttggcgtccgcggacggcgggagcccggaggaggaggaggatggggagcgggagccgctgctaccgcggatcgcctgggcccacccgcggagaggcgccccaggcagcgccgtgaggctgctggacgctgccggggaggagggcgaggccggcgacgaggagctgcccctcccgcccggggacgtgggggtctcccggagttcgcccgccgagctggaccggagccgccccgcggtttcagtaactattggtacttcagagatgaatgcattcttggatgacccagaatttgctgatattatgctgagagcagagcaagcaatagaagttggaatttttccagaaagaatctctcaaggttcaagtggaagttactttgtgaaggatcctaagaggaaaattattggtgtgtttaaacccaaatcagaagagccttatggtcaactcaatccaaaatggaccaaatatgtccataaggtctgctgcccttgctgctttggccgaggctgcctgattcctaatcaggggtacctttccgaagcgggtgcctatcttgtggacaacaagcttcatctgagcattgtacctaaaacaaaggtggtttggcttgtcagtgagacatttaactataatgcgattgaccgtgcaaaatcaagaggcaaaaagtatgctttagaaaaagtgccaaaagtgggtagaaagtttcataggataggactccctcctaagattggttcctttcagttatttgttgaaggttacaaggaggctgaatattggcttaggaaatttgaagctgaccctttgcctgagaatattagaaaacaatttcagtcacaatttgaaagattagttattttggattacatcatcagaaatacaggtattgaagttctctcatttgttcacgtaaatcttgttcattttcaaactatattcttgttatccaaatcaaagcggtaaacttttgttgcagaagtcttgaagccactttctctgtctgtcttggcaaacagatgtagtattgactctcctgggcagaattcatcctgtgtgggatagattctgactcatagcaggctcctagatcagttcctgtcccctagggaggaatttcctaggggcagggcaaagtcagatattggaaatgttatctgcataatgtgagtaattaaggcttcattgtataaattatgttaggtgcttattttgacattatgtaactcttagtgtagtctataaatacactaaactcttaatttttcctgtgctataaaggagcaatgacgtagaccagggatgtccagtcttttggcttccctgggccacactggaagaagaattgtcttgggccacacataaaaacagtancnctaatgncagctgatgagcttaaa

SEQ ID NO: 32142 - DNA, 1454 bp, Homo sapiens
gtgcgctggtgaggtggcgtccgttctacccggtcgctcccgttccgcgccatgcagagcccagtctctggcacctggctgctctgatctggtctcagcgcggagggagcagagggagtccatggaggatccctccgagcccgaccggttggcgtccgcggacggcgggagcccggaggaggaggaggatggggagcgggagccgctgctaccgcggatcgcctgggcccacccgcggagaggcgccccaggcagcgccgtgaggctgctggacgctgccggggaggagggcgaggccggcgacgaggagctgcccctcccgcccggggacgtgggggtctcccggagttcgcccgccgagctggaccggagccgccccgcggtttcagtaactattggtacttcagagatgaatgcattcttggatgacccagaatttgctgatattatgctgagagcagagcaagcaatagaagttggaatttttccagaaagaatctctcaaggttcaagtggaagttactttgtgaaggatcctaagaggaaaattattggtgtgtttaaacccaaatcagaagagccttatggtcaactcaatccaaaatggaccaaatatgtccataaggtctgctgcccttgctgctttggccgaggctgcctgattcctaatcaggggtacctttccgaagcgggtgcctatcttgtggacaacaagcttcatctgagcattgtacctaaaacaaaggtggtttggcttgtcagtgagacatttaactataatgcgattgaccgtgcaaaatcaagaggcaaaaagtatgctttagaaaaagtgccaaaagtgggtagaaagtttcataggataggactccctcctaagagggtctcactctgttgccccagctggagtacagtgttgtgaacagggcttactgcagcctcgacctcgtgggctcggataatcttcctgcctcaggcttctgagtagctgggaccacaggtgcacaccaccacacctggctaattaaaaaaaattttttttgtagagatagagtctcaccatgttgcctaggctggtcttgaattcctgggctgaagcaatcctctcgctttggcctcccaaagtgctgggattacaggtgttagccgctgtgcctggccaagttccttactctaagctccagtttctataaaatgagaatgacaaaaactacctcttaggttgttgtgaggagaaaactaagaaattcatgtcaaggacttggtacatagtaaaggttaagtaaatggcagcagctatgtttacttactacacattaggttttcttttttcttatcacctttaagtaaacctgagggatgatgagcagccagctaaacaagggtagagagggttaatgggaaaggcattctagaaaaagctttaagacttattttttagaaatgtatttggctta

SEQ ID NO: 32143 - DNA, 487 bp, Homo sapiens
aattcaagcttctaacgatgtacggggacatgaactgaattcttatttaaatagtatggttttttttcaataagtatatttatagtgacaaatgtggtagactaaaggtaataaaaatcattgtcttaagattatgttcttctgtatgtacgtgtttggaatatttagaatgtttatgaacacatttactataaatgatgccaaactatcattttcttcatatattaaaggtatagtttaattctttttttttttttttttttgagacggagtctcactctgtaatcccagctactcaagaggctgaggcacaagaattattgaacccaggagggagggtggaggttgcagtgagccgagatcacaccactgccttccagcctgggtgacagagtagattctgtctcaaacaaacaaacaaacaaacaaacaaaaaaattgaagtactgtactatatggaattaaaaccttttttaaaaatgacggt

SEQ ID NO: 32144 - DNA, 386 bp, Homo sapiens
ttgtgtttacatgacatattttttgacagtactgctgagaaatataaatattaatccccttgttcttgtactttcttttctaactatagttcttaaaattatagattggttcctttcagttatttgttgaaggttacaaggaggctgaatattggcttaggaaatttgaagctgaccctttgcctgagaatattagaaaacaatttcagtcacaatttgaaagattagttattttggattacatcatcagaaatacaggtattgaagttctctcatttgttcacgtaaatcttgttcattttcaaactatattcttgttatccaaatcaaagcggtaaacttttgttgcagaagtcttgaagccactttctctgtctgtcttggca

SEQ ID NO: 32145 - DNA, 173 bp, Homo sapiens
aaaagagaaagccccacctgagtatcaggaagaacccagtcctgctaactccacacaggttgcagttgcaaaggcaattaaagccactgtacagagcccacttcagcaccactcagaggctgggctggttctgagatccccaaagcggaagcaaccgtcctagcaaagtcttc

SEQ ID NO: 32146 - DNA, 544 bp, Homo sapiens
tctaaaatattgaaataaaatcatgtttggcttacttttcaaggaaataaaactgctgtactttcattcacagctgatgaaagaattacagaagaatatgggcaacaacaattgtagtagatttttaagtacctagttaaaaagtgttctgggccatccagatatatggaaagcaatattccttaatcttctctcctggagctcatttgctcacgtaaaagttaattataaaacattgctatatgacttctactggaggagaattcaccatgctgggaatggcagcaggttgcagtggagaaggctctgaatcgaccatgagggggctttgagttcaagggcaattacccaaccactctctgtgcctgttctccaaccagtcaaacaaatgggttggacatgatgaacttaaaggtccctttcattttgaaaaatgacacaaaaaggacagaaagacacattcagattcactttggtttctaagataacaccaaacactttgaaacttcccccttcatgtttttcaagcagaggaagtaaaaaa

SEQ ID NO: 32147 - DNA, 385 bp, Homo sapiens
atgttttgtcttaacatggtacacccaatccttgtaagacaaactaggaacacagcgatgggataccaaagccaacagacagcatctaattaggcattgcagaacactgtcctcaaaggaaaatgccaaagagcctggggatagggagagagtgggtccactcacaagcagagaccttccctaccccacacagccttctctggctttcttgagacatctgagctttcatgagtccaaacatctttcatggaaatatctgcatcaagaacaaatgcagtttggatcaatgttttccaccaatttctagatttgtgagaaaatgccaagcattcttttcttaccagtaaaagaatcacatgtcctaaataaaagaattaaattcttc

SEQ ID NO: 32148 - DNA, 1214 bp, Homo sapiens
caaaatgcattcagaaaatattgatgaatgctaatactaacttaattgtggaagtgttaggtgttcatcataggaaaaccttcattaccatggatacttttctctcagtcctgcctctagattgatgagaaagaatgatctacaataaattcaattcgtgcttctcccagatacagggttaaatgtgagacagcaacattttagttgcattaaaaatgtccctggttattgcttcggcctccctctgctgtaaaggctggatatgagtttgcatagcaagtagctaaacttaaactttcccactcttctgaaagatggtagaaagtttaaccagtaaaaatataatgcacaaaaggtaagttcatttttagtgtcttgcagcctgcttagttggtgtaaagaatggactactgaaagatagtaaaagcaccgaacttaaaattttactatcagaaacatgaaattgtcaccgaaattttatttaaaaactcacagaattgttggcataacagtgacttacagcttattcatcagagcaagttagtagaaacccaaatgctattctcagatatccattcttttctcagatattgacttgcgtgtttttacacttcctaatgaaattgtttaaaagcaacatatgtagttgtcaagcaagctaaattggtagccgaatgaacccaacgacgtgaggctgcattacattttgtaaatcctaagtcatattcaacttgttctatatactgatttccttattcctgttaggaaaggaagttgaaagtttagacttgtccagatttcagctttgaggattcctctatcacatgaggcttggggtggtctgcgtttgtttcagcttaagagccatagcaaagatgcttcggggtgttgaaagcaacagctacattgcagagaagcaaggacagaactcgcaggtgtccagaaggagagtgagctgtgggagagagtctgggaatgggcagcgatggaggaaaagagaaatgttgaggacccctcacctcccttgtactttgtttcttcaagcctaacgttgtgtaatctattgtgttgtcttgcttatccaggacgaaaaatggatctctaatgaatacaatcatatctgtaagctacagattttaccatcaaaaatatgatttattagtaaagctgccacatggcactgatttactggcctttgtattaatcatataaaa

SEQ ID NO: 32149 - DNA, 518 bp, Homo sapiens
gatatacagatgtccgaaaaagcacatcaagagatgttcaacattactagtcattagggaaatacaagtaaaactacaatgagatactactacatacctattaacatgactacacacacatacacacacacacacacacacacacaaaactgaggataccaagtgctggtgaggatgtggagtaattggaactcttacacattgctggtgagagtgcaaaataatacagtcactttggaaaacagtttgacagtgtcttttaaagttaaacatacaatatgatctagttattccacttctagatatttatacaaatataatgaaaacctatgtttgtacaaaaaaaaacttgtttgtgaatgtttattgatgccttattcataatcatcaaaacccggaaacaacccaaagatccctcaactggggaatgaattaaaaatgtaaaccaactatggtacatgtatacaataaatgagtactcagcaataaatgagagtaaactattgttacatgcaata

SEQ ID NO: 32150 - DNA, 592 bp, Homo sapiens
tctactgttaagactctactactaagacacagatgctcttgttgcactgttcagctgacatttaccagactgggacactggtttcctggcagtagtagctattggctgactcatgtctgccctcttctctggaggattgcacttgactgatgagagccatcttatgttgagatgattgggagattagactccttagcaaagctccattggtcctgtactgaagccagtggccaacccatggggtcatagcagcacaaaccactactttataagtataatggctttgtgccatgatctacacagcagaatttctcggggaaatacgtgaggacagacatctcctaaaatcacacttttgtttagttcaagggtgggtaaatttttctgtatggggacagatagtaaatattttagggtctgcaaagccatatggtctctattgcaacaactcaacaatgctggtgtagggacaaaggagacagtaattagcagagtagggtaccagcataaagacagataaatagagcagaatagagcccagaatataacccatcaatagaatatcaagtgatcttctacaagggtgccaaga

SEQ ID NO: 32151 - DNA, 181 bp, Homo sapiens
tctgttacccagaaagtagtgtcaagtatgttaaataaatatttaagtgacttacatagtgaagttaagatgtttctgtcacatagttgtaagaaatagtgtgtccccatttgagttcgttccataatttttgttagaatatattcctggaaatatgtgcctgccaagtacagtttttatt

SEQ ID NO: 32152 - DNA, 619 bp, Homo sapiens
gccccaggagttatgtcctggggttttaaagaatgtattaatttattacctggtcccttaaaagtgacttttcttatatatcaccttggcttgcatcgaatgcacctgcttttcagttctttttttttcacatagtacattaaataagagtttgttgaatgactattttctttttgtccagaattttgtatatgcttagcatagtatgtaaacaatgaaaagcattgtatagattttttgctcaattaagcatccagacatattgactcagaaatcccataagaatatatcttttgttaattagctggacgtggtggtgcgtgcctgtagtcccagctactcgggaggctaaggcaggaagaatcgctttaaacccaggaggcagaggttccagtgagctgagatcttaccactgcactccatcctggggacagaacaagactccgtctcaaaaaggaaaaaaaaaaagaatattatcttttgttgaggtgacaggaggagagaaggtgccttgtggggctggtgtcgcctttaagctgagtggactgttggctgtcctggggagatggggaattcagcacagtgcaggcagcagctagggaaggagctggagctggac

SEQ ID NO: 32153 - DNA, 260 bp, Homo sapiens
gcagagaaacatcattaaacaccattaagttccagtgagctgagatcttaccactgcactccatcctggggacagaacaagactccgtctcaaaaaggaaaaaaaaaaagaatattatcttttgttgaggtgacaggaggagagaaggtgccttgtggggctggtgtcgcctttaagctgagtggactgttggctgtcctggggagatggggaattcagcacagtgcaggcagcagctagggaaggagctggagctggac

SEQ ID NO: 32154 - DNA, 411 bp, Homo sapiens
  misc_feature (105)..(105): n is a, c, g, or t
  misc_feature (129)..(129): n is a, c, g, or t
  misc_feature (135)..(135): n is a, c, g, or t
  misc_feature (150)..(150): n is a, c, g, or t
  misc_feature (270)..(270): n is a, c, g, or t
atggctcgtactaaacagacagctcggaaatccaccggcggtaaagcgccacgcaagcagctggctaccaaggctgctcgcaagagcgcgccggctaccggcggngtgaaaaagcctcaccgttaccgnccgggnactgtggctctgcgngagatccgccgctaccaaaagtcgaccgagttgctgattcggaagctgccgttccagcgcctggtgcgagaaatcgcccaagacttcaagaccgatcttcgcttccagagctctgcggtnatggcgctgcaggaggcttgtgaggcctacttggtagggctctttgaggacacaaacctttgcgccatccatgctaagcgagtgactattatgcccaaagacatccagctcgctcgccgcattcgcggagaaagagcgtaa

SEQ ID NO: 32155 - DNA, 381 bp, Homo sapiens
tcattgagactctgggattcgggccattacatgaaaatgaagttgtttctgtgattttgctgcttaaatccttttggacacttgagccatccacagctaccctacattccagccactctaagactggcagtccccctacttgtcgcgatggttcacatctccatgcgtttgccaggctcttctctttcttggggatgttcttccccttctggtgtgtttgacccagtttcaatacaccttttaaaaaaactgctttatcgagatctaatatacatactggcaaggtttacccttaacccattttaaataaaaaattcaataagttttaggtatatttacagagttatggcaaccaccattcatacacatttttttgagact

SEQ ID NO: 32156 - DNA, 206 bp, Homo sapiens
attgttaccttaagcttgtatgcggctcccattagtaaaagaaaaaaggacaatggatgttggatatataactaacagttgggtaccaattgctacatgcacttgatggatgatttagtgcatttggttgtgtataaaataataatgcagagtattttataaaacagaacatctggaaacaaattagttatatgtatttaaaaata

SEQ ID NO: 32157 - DNA, 949 bp, Homo sapiens
ccaccttggcctcccaaagtgctgggattataggcatgagccaccatgcccagccaaaaaactactaataataaaattcttaataaagaatagcagcagttaaaccatagttaactcaaaacaacactgatgatacaatatatatatcatcagttgatacaatatacatatgatacgatagttacagagagtcttttctaagaattatggagattctgattgtctttgtgtatacattgcagtgggagcttcttgctatgcatgatgttggcagtttggtttcttatttttagtagggtaaagaatttgagttctcaataaattccattaacatactgatttagtttatgaatgtcaacttttagaaacccttaatttacatagttattagtataacctttagcctcataaaaattatggaattatgtctttttgtacatcattatatttgatatcaatttaaataaagcattatcccattgttacttctttttaaaggattttaaatttgttttagcctaaacttttacatatcccttgtaaaagtaaataaaaatatgagaactaatttgtcagcatagaatttccagacatgcaatacaaatttctttaacttgggacatttgcaagtttaaaataaaatgggtctttcaaaaaatggtgttgtatgggagtggtggttcacacctgtaatcctagcactttgggaggccgaggcaggtggatcacctgaggtcaggagttggagaccagcatgggcaacatgtagaaaccctgtctctactaaaatacaaaaattagccaggcatggtggtgcatgcctgtaatccctgctacttgggaggctgaggcagcagaatcgcttgagcctggaaggcggaggttgcagggagccaagatcgtgccactgcatgccagcctggacgacagagcaagactgtgtctcaaa

SEQ ID NO: 32158 - DNA, 658 bp, Homo sapiens
ctgatctccaggacaagcatggttgagaatcagtgatgtgatctggtggctttgtctcccaagctgcttattttttagtagtgtgtgtgtattttgtttaatcttcaagtgaattttaagtttccagttagatagtacaatagtatggtataggggttcatagtagctgagtacatacgtgatccctaagtaacagtgctgatctggctccttgccttcagttcctgccttgtgttgtcagcccggtcttgtcagcccagtctcttcagcttagccaccctagtcttcttttagtgttaactaacgtatgatttttcttcctaccacagggtcgttttccatgtttttcctggctgagaccacccatccgtggccacccccttaccccacccctgggcccagacgtggccacaatttttgaaaaagtccttgatgttcctgtcctttggaacacttccctcatttgcaattttctatccatgtgtgtgattatttgcttgtttggctcccttattagaccaagctttttggatctgcctattcttatccacttttatttctagcatctcctcagtgcctgagatacagcagatgttgaatgaatgaataaatgaaaagtgcaaggtaactagacagaaattcaattagttgtatgtgt

SEQ ID NO: 32159 - DNA, 430 bp, Homo sapiens
ttacttgaaggtgttcataattcagttgcgaagtaattttctcagtagcgtgtgcacaaatctcagctgatctgaatctatctgaaattaaaatacggtgtaaggaaatgttgagatacaagtatttttcattaatttttttctgaaatgctctgaaccctttcagcctggagacttttttccgctagcaaagttctttcccatgtgctcttatcattgtttctcttcctgttctgatttcagccttaagaatatgtataattcttaaaatggaacttcttagatctcatcctccaactcatcatttcctcttcgatcttcttctgtgtattctaggagaacatttcacatttgtcctgtacatcactgggtcaatattctgcaggatttgttctgctcttgagtgccttaaatgcagatttaaattctg

SEQ ID NO: 32160 - DNA, 407 bp, Homo sapiens
cagctactcgggaggctgaggcaggagaatcgcttgaacccaggaaggggaggttgcaggcagtgagccgaggccgcgccattgcactccagcctaggcgacagagcgagactccgtctccaataaataaataaataaataaataaagttgaatttctgagtctgagaataggcatttaacatttcaagaaatacagagagagagacagacagagagagagagagattgttagggcccacttccatcattatagcctaactgtattgtcagggcttgacttatgaaacctttcccaaggtctcctccatctgcctgcacattcccctgcctcactggattatagtttacttttagttagctattcttaagatttatttctctaaatgaagcagtaaatgttgattga

SEQ ID NO: 32161 - DNA, 681 bp, Homo sapiens
ccacctagaagtgagaatacgtggtgttttacctttctgttcctggcttattccacttaacacagtgtcctctagttccatccaagttgccaagaatgacaggattccattctttttgaagacggatttcattctttatggctgaagtattccactgtgttcacttctttgtaagtccatggttggcacttcatttatgatttagtatcttctctgatgccctccaaacctagctatcaagctattcagtaagaaattctccacacaatttttagtatttttcaaaagaaaggatacttccactgctcaaaaaatcttaattatacagatcagtaaaagattaagtgctctccaaatgtgcatgtggactgatgggaagatgattaaagatcaagaaagggtcgggcgcggtggctcacacctgtaatcccagcactttgggcagctgaggcgggcagatcacaaggtcaggagttcgagaccagcctggccaacatagtgatctctactaaaagtacaaaatcccgtctctactaaaagtacaaaaattagcctgtagtcccagcttctcaagaggctgaggcaggagaatcacttgaacctgggaggcggaggttgcagtgagctgagatcaggccactgcactccagactgggcgatagagcaagactccgtctcaaa

SEQ ID NO: 32162 - DNA, 434 bp, Homo sapiens
ctttctgtgactcatttccttgtccataaaatgggaatattaattgtacatgtcttatggattggtgtgtgaattcagttagcgagtgtagaatataacttatagatcaaagtagagtaaatggaaagggctcaactatggtgttgctactgccattgttattacaggcacacagttcgagctataatcatttcaagggaaattcttatgtgtcagttctggatcgaggtctgagattctgcatttcaaacaaacttccaggaatgctgctgcttcttggtccacacttggagaaataagtcagcagagagtcctctcgtttcctattgtaccatgtctgtcttttgtctcctgcttattggcctctgtaaggaactcacagctgctataataaagtaccaaaaactgggtggcttaaaacaacagaaacttac

SEQ ID NO: 32163 - DNA, 670 bp, Homo sapiens
ggccattagtaaaatgggaatgcctgctgtgttagtttattgatgctgccataactaattacctcaaatttggccacttcagacagcagaaactgattttcttgccgttggggagaccagaagtccaaaattgagcagggcctcactccctctaggaacctgggggagaatccggtctttgctccttccagcctccagtgcatgccccagcattgctgggctgtggctgcatcacctcagtctcagtctccctcttcacagctctttctactcttttcaagatccttaacctaatggcatcttttgtcttgtaatatttactcttttaaaaaactatatgtgtgtgtgtgtgtgtatagatacatatataagtgcaccctactactcacaggttatggggaatccaatgtgtgtatattggggggctactgtaccatcagcctgctccaccgtgttacctgccccacagtaggtgagaacactctgagaactgtaaagccctgtccagtatggcgtgtacatatccctaatgcagaaacagatgtgcaagttattgttcctgtcttcaccaagcttacacactaacaagatgaaaaaataacagtaagacaactgcatgatctttttgcttttatttttcatgcaagaaatttaattggaaaaaattaaa

SEQ ID NO: 32164 - DNA, 2607 bp, Homo sapiens
tccttttaatgtgttttaacattttttaatcaacatcgtttaaaaataatttactaaggattagattatttaatgaatgtctttttttctatatattgaattagatgttatcccaaaaaaaatatcttttcacttcaaaatgaaaatatatgttcaaagatgttttatttttagaatagttataaaaagtattagtcttaacataatgtgtcttgttctttttaccaataataatttatcaaaataagagggaaagtgcaatcaaatctgaattattttactatttgtttctagacacactacttaacactcctaaagactactttgagtaggcaacataactaaatttttctagtttcttatgatacaggttcataaactacaatatttggatttttttccccaaggcacaaaatgtataatggagaccaaatagtgatctgatccatagtatcctatgcctatacactttaaaatgtatatacattttagacaaaaatgcacactccagtattaatatttgtgctaccatctacttggagaagtttaatgagaaaattttagaagaaaagtattacaaacaatattttgactctattacctgttttgccttatacattttagaaactggaaattttttaaagaaaatgctttagttttcttctgttcttcactgtctacagtgtgcttttgtatatggatcaggactgagcaaagtaattacatgtatcagagatacttatctctatactaattcacagacagctcctgatgtaaggatttagagggccttctgccctctgaatatatggtgaggagaatggggtatctggaaaaggaaaatgatctggataaatctgagacctggggggaagtttgttttatatgttcattattggttgttacatatcaaggctgttttggttatgtatcaatattgtggtttatttgagctggaagtgattttttctgtgtatgtatatgtatacacttcaataggttttaattttgaagtgaatatttgccatgactccattttccccataccacttcagactttagcctgtttagttttaaggactgaaaatggtaggtttgggcagaagaatgaatttgaactttgatggggtttttttgtttttactttctatcttcataaccatttaaagcgatttagcttgaaattaaattttatcaggctaccaacatgttatttatttatttaataaacacatttattgaaaacctatactattgtattggcaccatacagggtattgtatttatactagtgagcagaccagggcatttccatcctcatggagttcatggtctaatgaaaatagctggggccgggtgtggtggctcacccctgtaatcccagcactttgggaggctgaggtgggaggattgtttgagcccaggagtttgagaccagccagggcaacatggcaaaaccccatgtgtacaaaagattaaaaaattagccagatgcagtggcacatggctggggtcccagctacccaggaggctgagttgggaggatcatctgagcctgggaggttgaagcttgcagtgagctatgattgccactgtactctatactccagcctgggtgacagagtgaaaccctgtctcaaaaaaaaaagaggaaagaaaatagctaggagacaatcagagcagatcttgggcttctgtggctcatctcagccctttataactggcctgagaagagggtttatctacttgtgcaagtggcccagaaatctcactcgtacatgaggctttggaacatccttgcaaaggtacgctgaaagcaaattgctgttttcctggtggttctgcacgtttcctaacttttatcatagtttgattttcattatttaagaaaaaataaaaaatccaaagaccataagatggcattagattttttaccattaaattattaatgcctatttggtgctcataaagattaatcatgtcacgcatgtttccaatctttcttttgcagtatattattttctaaaaattgttacatgcaaatttaaaccaagatttatcagtaaaagaaaaaaatagaatccttaataatgtaaatgttgttatatatgctaccctggtgaaaatatttttataaatcatgttgtcatttatgctttatgtagcctatttttcaataacctttttttaaaagcaattttttttgacaccaagattgttgatttttaattaacaccagttggtggcactagaaacctgaaatttttcaaagatgaacaaagaaaaattgaaaaggtaatctaaacatggagaatttttaggaaaataaatgaaaaatataattgtatattagagatgtatttttcttctggaatggaattctttttctaaaatgcaaatcgctatccattttgactgcaatgatgaaacttgtttatcttccagaggacatatatatatgtgtgtgtgtgtgtattgtacagatacctttaatttgattacactgtttcttgtaaatatgtttctgtataaaatgaaacttttcaagaggattctatgtatatattgtacttattaaataggtaatgcctatttaccaaaaaaaag

SEQ ID NO: 32165 - DNA, 564 bp, Homo sapiens
ttcactgagcccgaacttacacctcccctggctgtggcgctgcacagcgccctgagagtgactttgtctgacttcttcccggtggctcgccgggccgccgccgcgtggttggcgccagcgcactggggcagtcgcgcgcgcccaggtgcgggccgcgttacctcagcagacgctagagagtgaatgagccgcgcgggcccgggacccttggggctcttcactctccaggccgtcccgtgggcgcgctagccttttcaagtgatagtaatcggagacttttccgttacatgaggctcaacaaaagattgtaattccagcagctctgtttgggaaggcactaccgcggcgagtccagggcccggccgggggtcggcggctgccgggcggctggggcgaccgcggaccgtgcgggaccggtagggggtcgcgggccggctaggctcccccgcgcccctcctcgtggtatagcctgcatttctaatacaatgctgttatgctaatcaggtgacatcaccgcccagcacacggcgagtggctcctgataaaattacaaaccggcggccg

SEQ ID NO: 32166 - DNA, 500 bp, Homo sapiens
tcaatgggaagtttctaaggtagccgtgtaattgaaggtggaccttggaggagaggcaggattggggtggaaagaggataggaggtattctagatagataggagctggctaaggaaagatccagaaactggtgggaacttaaatattcagctgccatgacgatggttggtatgtagggttcgtatgaatgaaacgtgactaccagggcagataatgaaaggctttcaatcccagagtaagagatatagggccaggcgtggtgtctcatgcctgtaatcccagcactttgggaggccaaggcaggtggatcacttgaggtcaggagtttgaaacccgcctggccaccatgtcaaaaccctactaaaaagtacaaaaattagccagatgtggtggctcacacctgtagtcccagctacttgggaggctgaggcatgaatcgcttgaacccaggaggcggaggtttcagtgagccgagactgcatcactgcactccagcctgg

SEQ ID NO: 32167 - DNA, 750 bp, Homo sapiens
atcttaaggaaagagagaggcctgggattgtggactaaggcagaggagggacagaaagacctagagtaggtctggcactggaaggtggtattaatacatttcttttcttctcccagttgaatttggccagcactgtttcttttgactttagagattatttcccaatgtttgatgaaagttttgaaatctttagatatgttgggaaaattgtggacagtctttcaacatagtacaagttccttttccaccagctgaggtactggcagctataattttaattccttttctagttgggtaagttttctcttcagttcagccatcctttagagctccttcacccagctctctctgctctctctgtccccttcatcaccaagacagacattctgggtcagagatggaggttgtgtccttgtcaccacatggaggaattctgtgatcagaagcagagcacctgtgttttatgcatttaaaaacatctagaccgggcacggtggctcatgcctgtaatcccagcactttgagaggccgaggcaggtggatcacctgaggtcaggagtttgagaccagcctagccaacatggtgaaactccatctctattaaaaatataaaaattagctgggcatggtggcgtgcacctataatcccagctactcaggaggctgaggcaagagaatcgcctgaacccggcaggtggaggttgcagtgagccaagatcacgccactgcactccagcctgggtaacagag

SEQ ID NO: 32168 - DNA, 235 bp, Homo sapiens
cgagtagctgggattacaggcacgcaccaccatgcccagctaatttttgtactttttgtagagacagggttttgccatgttggccaggctggtcttgaactcctggcctcatgtgatccacctgctttggcctcccagagtgctgggattacaggtgtcagccaccacgctgggcctgatactgccacactttttaatgttctaattaaaatattttttaaaaaaatactgtgta

SEQ ID NO: 32169 - DNA, 167 bp, Homo sapiens
tggtttccctcccccaaggctgggcagggggaggggtatatctgaggtcgctggccctccacgagtgacttcccaagaagttctggacctggggaatcctaacctggggcgagggtgaggggagtggatgagactagaaactctttgttccaggtggattttcacag

SEQ ID NO: 32170 - DNA, 318 bp, Homo sapiens
tcgccctgtgttcctcatcacaggtcctgattgctccctaaaccaactccaggacaaagctggatgtgtctagtgtttttattagaacccgctttccgtaataagagcacatgtggttttgctgcactccagcactcgcctgaaaatatggagagaactagggtccagacacattaattttcaggtacttctgacatttaacttattttttctatctttcttgtcaaagttttactccttccttgtctaagtttctgtttgtttgcttgtaatacattttatgaggcttaattgaaaggtaatatacttcacacattt

SEQ ID NO: 32171 - DNA, 221 bp, Homo sapiens
aagaaatgcctgggaaacatatggctgggaactgactctgctttcatagagaagacttttggatcccgcagatggtaccccttatactaagaagggagtacttctgttgggatcataacctctttttaaaactaaggtgatttttgtcattttaacaccatttggaagcactgtaaagcttgactttttatctatttatttatttactttttaagagacag

SEQ ID NO: 32172 - DNA, 556 bp, Homo sapiens
gttttatgtaataattttcttggtgaggtcaatttacatagttttggtactttcatgtcagatttctaaggtagtataatttagtttagaggaagaatttctacacagatcatgtaattgtctcttcattatatatcagggtaaaatctataaaaaacaaaattggtttgagaacaaagctgtcattacttgcaagatgaaaacagaaaaattgcatgtgtttattaaaacacagaagtatattcctgtgcaaattaatgcagattctgaagtgaaagacaggacttttgagagattttgagtccaagggttcacctcttcaaacacaactgaaaaaactctattttttttatttttaaatctaatcagtttatatatgcccaggtccagcaaaaagaagctgggttgataatgtgttttgcagttattcaagctagtttgaaagagtacctagcagtgattgtgaagaccaatgattgtgctactaaggtctctcaattgccagacacccaccaagtattttttaaatatgctattctgttttgaaactcaaaac

SEQ ID NO: 32173 - DNA, 645 bp, Homo sapiens
aagctgcggttctccaggagtctggttgttcctcgcagccgggacggaatgctcaagtctgtcaccacacagctgtcagccaagggaggtgcagagctggaggtggaagggagtcgtcttcttagcttgacctttgaagccctttgctttacgactggatgcttgatcatttttctcggcctttgatcttcttgaaatcgcaattgtatctgatgcctcagactatataaactaatggatgagttaagtcccagacaagatgtatgtctgcgttcacagagtcacctgcatatgaaaatgagactgaagaatgtagcctgagcatccccttcctgcgcacttggccctggagtctataggattcccctccaccccatccaagccctccaggatttcacacaacaaaaactgagtatgtaacccaattataacatagggcccaaggaaagtgcattgattgcttcttgggtaactatggcattcacagcgtttgaaatgtcatcttgaacgccatttctgcctaacgatgtgtgcaaatgtatatttacacttacaaagcctcttttgctgtgttcactgtttagagctttgcctttgtaaagtgcagccttcatagaaaacaataaaagtgtgttcatataaaag

SEQ ID NO: 32174 - DNA, 429 bp, Homo sapiens
gaattcctaacttacaaggtggccatgaggaaaagaggagaaaaatctaatgtacctggcatcatggggtaggcactgttttttgtttttgtttttgttttaagatactagttctcaatccagaccatatattagagtctcctggagatcttttaaaggcatatttatcttctatgccaattcagtcacaatctctgccattgtgaccccagcatcaggattttttttttattattatcatactttaagttctgggatacatgtgcagaatgtgcaggtttgttacataggtatacatgtgctatggtggtttgctgcacccatcaacccatcatctaggttttaagccctcatgcttatggtatttgtcctaatgctctccctcccccttggcccccagctcccgacaggccccagtgtgtgatgttc

SEQ ID NO: 32175 - DNA, 483 bp, Homo sapiens
cgcctccagtggtgagtctgtgaggccagagaagagaagctatgaccgtgcaaacatgcatgttatggtgttggctgatgcggaatcaggaagcttggaggagctcttgcatgaggaattgcagaacttaggggcatgaatttgcacttccagatgtgaaggttgcaggcaccgggcgttgcagaggaagtgggcaagctcaccttgtagagaacttacttggggtttgtaatttgtatacacttcttacccagcagaaacagcttactgaacacccctcgggtggctggatgatgtgctagcaactgaaaccatctctgcgacttaagcttctctggtgcgtcgcgccccacgtgcttctccagaatcccgtttggaggggccaagcaagtccaatatagataggtttatactgaagccatcagttttgtttcttacatcgtttgtaaacagcagtattatcctggaacttgtttcctacag

SEQ ID NO: 32176 - DNA, 835 bp, Homo sapiens
ctttttatgaaaaaagtagaattttttaaagagcagagaaaagcacaatgaagacagaaagatcacctgtatattcttattgaccaaagatgatctatttggggtaaatccttttttttttttttgagacgggagttttgctattgttgcccaggctggagtgcaatggcacgattctcggcttaccgcaacctctgcctcccagggtttaaacaattctcctgcctcagcctcctgagtagctggggattacagggcatgcaccaccacggcccggctaattttgtatttttaataggaggacagggtttctccatgttgaggctgggcttgaactccagacctcaggtgatctgactgcctcggcctcccaaagtgctgggattacaggcaggatccacgtgcccggccggtaaatccttttaatagaggagtttcaatatttctcctctgccatagtattagaaagaaaagaatcattattgacatctttacgacattgagtttttctcttgtacctggtgtgtctttatttcagtaggtattcttttatgtgctttagtaagtctttatatttttagcataaaagtgtacacatttcttgttttacttatttctagatacttaatggcttttgtttataatatgattgggatattttttctgttgtgtaattgattactattactatgtactaaactgttggtttttgtctaaggattgtaacattgatgaactactttagtagatgaaatggtttcttcatgagattgaattgtctaaagagatgttggtattatttgtaaataaaagtatttgcctattcctttctata

SEQ ID NO: 32177 - DNA, 655 bp, Homo sapiens
ctactactattaaattgacgaccgctcgacttccgttctcaaaaatgttgactattaatgagtcaagcaataagtagagtgataggaaccacagctgctggagggctctctctgatctggcatggtagttttttatctcccagaagcctgtaaaccaaaaataaaagtctaagccccccaaccaactgaatggacccctcctatcggccaagggcattccaaagttaacctaaagaactagttcaggccatgatgggaagaggtgggggtcagacatgcctcgttctaccctcctcccattggaatccaggcacagctgaccagcattaacattaacacagggaccttaatactggacaaacagattgtttttagcaatgacatcccaacagcacagatagcaggccctgaaagaaattgaagtattttaccgcaaactacatttgaggactaaactctaatttttttcctatcttgcccaaattcctatctaaggggcctggataggacccctacaaaccataaattttcatcagataggttttatttaaccctatatatcgtgacttactttccaatctgattctggtgtaacattacatgacaaagaagaaaaaaaaaaagtcgacgcggccgcgaaattaatagtagtagg

SEQ ID NO: 32178 - DNA, 4224 bp, Homo sapiens
atgcaaaagtccaggacagtgggccactttcagtcttcaaagagaaagataagaaattctggattttcaaaatccttttgaagccttttaagccattgattattattattcctaaagaaaatgaagataattacatatttttgcatttgggcagtagcatgggccattccagttcctcaaagcaaaccactggagagacatgtcgaaaaatccatgaatttgcatctcctagcaagatcaaatgtgtcagtacaggatgagttaaatgccagtggaaccatcaaagaaagtggtgtcctggtgcatgaaggtgatagaggaaggcaagagaatacccaagatggtcacaagggagaagggaatggctctaagtgggcagaagtaggagggaagagtttttctacatattccacattagcaaacgaagaggggaatattgagggctggaatggggacacaggaaaagcagaaacatatggtcatgatggaatacatgggaaagaagaaaacatcacagcaaatggcatccagggacaagtaagcatcattgacaatgctggagccacaaacagaagcaacactaatggaaatactgataagaatacccaaaatggggatgttggcgatgcaggtcacaatgaggatgtcgctgttgtccaagaagatggacctcaagtagctggaagcaataacagtacagacaatgaggatgaaataattgagaattcctgtagaaacgagggtaatacaagtgaaataacacctcagatcaacagcaagagaaatgggactaaggaagctgaggtaacaccaggcactggagaagatgctggcctggataattccgatgggagtcctagtgggaatggagcagatgaggatgaagacgagggttctggtgatgatgaagatgaagaagcagggaatggaaaagacagtagtaataacagcaagggccaggagggccaggaccatgggaaagaagatgatcatgatagtagcataggtcaaaattcggatagtaaagaatattatgaccctgaaggcaaagaagatccccataatgaagttgatggagacaagacctccaagagtgaggagaattctgctggtattccagaagacaatggcagccaaagaatagaggacacccagaagctcaaccatagagaaagcaaacgcgtagaaaatagaatcaccaaagaatcagagacacatgctgttgggaagagccaagataagggaatagaaatcaagggtcccagcagtggcaacagaaatattaccaaagaagttgggaaaggcaacgaaggtaaagaggataaaggacaacatggaatgatcttgggcaaaggcaatgtcaagacacaaggagaggttgtcaacatagaaggacctggccaaaaatcagaaccaggaaataaagttggacacagcaatacaggtagtgacagcaatagtgatggatatgacagttatgattttgatgataagtccatgcaaggagatgatcccaatagcagtgatgaatctaatggcaatgatgatgctaattcagaaagtgacaataacagcagtagccgaggagatgcttcttataactctgatgaatcaaaagataatggcaatggcagtgactcaaaaggagcagaagatgatgacagtgatagcacatcagacactaataatagtgacagtaatggcaatggtaacaatgggaatgatgacaatgacaaatcagacagtggcaaaggtaaatcagatagcagtgacagtgatagtagtgatagcagcaatagcagtgatagtagtgacagcagtgacagtgacagcagtgatagcaacagtagcagtgatagtgacagcagtgacagtgacagcagtgatagcagtgacagtgatagtagtgatagcagcaatagcagtgacagtagtgacagcagtgatagcagtgacagtagtgatagtagtgacagcagtgacagcaagtcagacagcagcaaatcagagagcgacagcagtgatagtgacagtaagtcagacagcagtgacagcaacagcagtgacagtagtgacaacagtgatagcagcgacagcagcaatagcagtaacagcagtgatagtagtgacagcagtgatagcagtgacagcagcagtagcagtgacagcagcagtagcagtgacagcagcaacagcagtgatagtagtgacagtagtgacagcagcaatagcagtgagagcagtgatagtagtgacagcagtgatagtgacagcagtgatagtagtgacagcagtaatagtaacagcagcgatagtgacagcagcaacagcagcgatagcagtgacagcagtgatagcagtgacagcagcaacagcagtgacagtagcgatagcagtgacagcagcaacagcagtgacagcagtgatagcagtgacagcagtgatagtagtgacagcagcaacagcagtgatagcaacgacagcagcaatagcagtgacagcagtgatagcagcaacagcagtgatagcagcaacagcagtgatagcagtgatagcagtgacagcagtgatagcgacagcagcaatagcagtgacagcagtaatagtagtgacagcagcgatagcagcaacagcagtgatagcagcgacagcagcgatagcagtgacagcagtgatagcgacagcagcaatagaagtgacagtagtaatagtagtgacagcagcgatagcagtgacagcagcaacagcagtgacagcagtgatagtagtgacagcagtgacagcaacgaaagcagcaatagcagtgacagcagtgatagcagcaacagcagtgatagtgacagcagtgatagcagcaacagcagtgacagcagtgatagcagcaacagcagtgatagcagtgaaagcagtaatagtagtgacaacagcaatagcagtgacagcagcaacagcagtgacagcagtgatagcagtgacagcagtaatagtagtgacagcagcaatagcggtgacagcagcaacagcagtgacagcagtgatagcaatagcagcgacagcagtgacagcagcaacagcagcgatagcagtgacagcagtgatagcagtgacagcagtgacagcagtgatagcagcaacagcagtgatagcagtgacagcagtgacagcagtgatagcagtaatagtagtgacagcagcaacagcagtgacagcagcgatagcagtgacagcagcgatagcagtgacagcagtgacagcagcaatagcagtgacagcagtgacagcagcgacagcagtgatagcagtgacagcagtggcagcagcgacagcagtgatagcagtgacagcagtgatagcagcgatagcagtgacagcagcgacagcagtgacagcagtgacagcagtgaaagcagcgacagcagcgatagcagcgacagcagtgacagcagcgacagcagtgacagcagcgatagcagcgacagcagcgacagcagcgatagcagtgacagcagcaatagcagtgatagcagcgacagcagtgatagcagtgacagcagcgacagcagcgatagcagcgacagcagtgatagtagtgatagcagtgacagcagtgacagcagcgacagcagtgacagcagcgacagcagtgacagcagcgacagcagtgacagcaatgaaagcagcgacagcagtgacagcagcgatagcagtgacagcagcaacagcagtgacagcagcgacagcagtgatagcagtgacagcacatctgacagcaatgatgagagtgacagccagagcaagtctggtaacggtaacaacaatggaagtgacagtgacagtgacagtgaaggcagtgacagtaaccactcaaccagtgatgattagaacaaaagaaaaacccataagattccttttgtgaaaagtttggtaatgggataggaaaaaaagatttccaagaaagtaaagaaaggggagaaataaacataagacgtatgtaaacaaaaacaactgggggaatcaaatcaaacagttggattcagaaccaagacctaactcctgcagagacagactctgaatgcatgacctttggtacatgcctgttaatattcatgttctgaaaatattttgttaaaagtgtaaatctaaacataaaagaacaattaaaatattctttaatacttcacacagaaacctcaagtaatcactacatgataacttcaatttaag

SEQ ID NO: 32179 - DNA, 243 bp, Homo sapiens
tagctatctacatggaaaaaatattaaccttgattcatacctcaaaccacacaaaaatttaattaaaggtggatcacaggcctacatgtaaaagttaaaactataaagcttctacaaaaaaaaaatgaatatttgattgactttggagtaggcaagaacttcagataagatacagaaaacactattttaaaaaggataaatgggctttatcaaaattaaaaacttctcatcaaaagacacaac

SEQ ID NO: 32180 - DNA, 924 bp, Homo sapiens
atgctacgtgtagtggaaggcatcttcatttttgttgtagttagtgagtcagtgtttggggttttggggaatggatttattggacttgtaaactgcattgactgtgccaagaataagttatctacgattggctttattctcaccggcttagctatttcaagaatttttctgatatggataataattacagatggatttatacagatattctctccaaatatatatgcctccggtaacctaattgaatatattagttacttttgggtaattggtaatcaatcaagtatgtggtttgccaccagcctcagcatcttctatttcctgaagatagcaaatttttccaactacatatttctctggttgaagagcagaacaaatatggttcttcccttcatgatagtattcttacttatttcatcgttacttaattttgcatacattgcgaagattcttaatgattataaaacgaagaatgacacagtctgggatctcaacatgtataaaagtgaatactttattaaacagattttgctaaatctgggagtcattttcttctttacactatccctaattacatgtatttttttaatcatttccctttggagacacaacaggcagatgcaatcgaatgtgacaggattgagagactccaacacagaagctcatgtgaaggcaatgaaagttttgatatctttcatcatcctctttatcttgtattttataggcatggccatagaaatatcatgttttactgtgcgagaaaacaaactgctgcttatgtttggaatgacaaccacagccatctatccctggggtcactcatttatcttaattctaggaaacagcaagctaaagcaagcctctttgagggtactgcagcaattgaagtgctgtgagaaaaggaaaaatctcagagtcacatag

SEQ ID NO: 32181 - DNA, 101 bp, Homo sapiens
tgtctgttctcaaactcctggtcttaagtgatcctcccacctcagcttcctgaagcgttggaattataggcaggaaccattgcacctggcccttgtctctt

SEQ ID NO: 32182 - DNA, 853 bp, Homo sapiens
tctgaagctacagtgggaagttataaggggttgctgttttgacaggtgtgagccctccctcccagccttcctgccctcccctttccctccgtacacggcagagtgaattattccagctaatagcagttccctgtagagcagagcctgctgtgtgcttgagaacaacaggtaggcagagatgagcagcggttaatatcttagttctcttttatcaagttatgattaagtaaggcaaagacccttttgaagccctaccaatcagtttgagaaagcgtgttagtatgtagcgagactacttaaaatatatatactacaaattatgtacacacacagagtgtccagaagctgaaaattggtttcccctgttaaattttgctagtcgtcttgcagaccaaaagagtgaattcccaagtcatttgcaaactcatttactaggaatcccaatggtccactgtcagaagacaaaatggaaattattgagatggtgctggatttggtaggaagtattgcaccttgactttaattcctgtattccttcattcaaagaaatacatatttgatgactgctgcgtgccagcctgtgtagtggaagctggtgattcaaatgtttctgcccatgtgaaggctgacatcctagcggggaagaaggatgatacacaagtgaactaataggcaagataatctcaggtcaggaggtagtggtgggggcctggtgtgaagatctgggatgagggaccaggaagagcagaggtcgggaggggaagggctgaggcaggagtgaggcatgatcagtgaaccgagatcatgccattacactccaccctgggcgacagagtgagactgtcttaaagat

SEQ ID NO: 32183 - DNA, 567 bp, Homo sapiens
ctacagtgacccttacagaagagcatctgtcatttttcttctttattcgtaataaaaatttcccaagattatctccagcaccttggcatttcactgctgtaaagagcatgtctggagatttcaccatgtgcttcagcaggtaatttatagatgatttttaacccacacaccaatatttcatgacctgtctcagcattcattcttagatgaccacattgttaatacttccccatatagatcatcacccatttattccaatcatctggattcctaacaaaacattttcccattttctttagtaaccaatggtgtagaatcttgtcattattgtttgaaaacctaaatattacatcccttgtttccttactcagtctcaaagaactcaggtaatatagtcgaaatcttagaggccaggagcagtggctcatgcctgtaatctcggcacttttggaggctgaggtaggaggatcgtttgagcccaggaaatcaaggctgcagtgagccgtgatcatgccatgccactgcacttcagccttggcaagagagcaaaaccctgtctcaaaaaaa

SEQ ID NO: 32184 - DNA, 765 bp, Homo sapiens
ctacagtgacccttacagaagagcatctgtcatttttcttctttattcgtaataaaaatttcccaagattatctccagcaccttggcatttcactgctgtaaagagcatgtctggagatttcaccatgtgcttcagcaggtaatttatagatgatttttaacccacacaccaatatttcatgacctgtctcagcattcattcttagatgaccacattgttaatacttccccatatagatcatcacccatttattccaatcatctggattcctaacaaaacattttcccattttctttagtaaccaatggtgtagaatcttgtcattattgtttgaaaacctaaatattacatcccttgtttccttactcagtctcaaagaactcaggtaatatagtcgaaatcttagaggccaggagcagtggctcatgcctgtaatctcggcacttttggaggctgaggtaggaggatcgtttgagcccaggagtttgagaccagtctggacaaaatggtgagaccccatctctatttataataatttttaaaaactcatagaaatgtctccatagataaactactcagtaggtaataagaacagcatctttaagggtatggaggcataaaagtgcacagcacatttgggaaaatgcaacgtggctgacacaatgaggccaagaatgaggctggcaagagaggaaaatcaggattccaactggcaccaattgtgaatcataaaagccaccatttatggcgcatttattatgtgg

SEQ ID NO: 32185 - DNA, 379 bp, Homo sapiens
gacatggaagcaagaatgtccatcaatggataaatggattaagtcaatgtagtatacacatactatggaatattattcagcttcaaaaggaaagaaattgaccgggtgcggtggctcacacctgtaatcccagcactttgggaggccgaggtgggtggatcatgaggtcaggagttcaagaccagcctgagcaagagggtgaaaccccgactctactagaaatacaaaaattagccagtcatggtggtcggtgcctgtaatcccagctacttgggaggctgaggcagagaattgcttgaactcaggaggcggaggtttcagtgagctgagatcgtgccactgcacttcagcctgggcaacaagagtgaaactccatttc

SEQ ID NO: 32186 - DNA, 377 bp, Homo sapiens
tacaaaagagtatacgcatttgaaagactcaacttcaatactattaaataaatgcataatataaaaacagtgtgctggcttttaaaaaattctttaggctgcgcgcagtggctcacacctgtaatcccagcactttgggaggccgaggctggtggatcacgaggtcaggagatcaagactatcctggctaatatggtgaaactccatctcaactaaaaatacaaaaaattagccaggcgcggtggcatgctcttgaagtcccagctacttgggaggctaaggcaggagaatcgcttgaacctgggaggcaaaggttgcggtgagctgagatcatgccactgcactccagcctgagcgacagagcaagactctgtctc

SEQ ID NO: 32187 - DNA, 1947 bp, Homo sapiens
tcagattatgattaaattagatattaaacacttcaaccacataagaatattgaggactgttgaatgagtcctgtgctctggtggtcctggaacttaattttatttatgaattttcagtcattagagaagagtatggtgtggatatgggaggttggattagccgactaaactttgaagtttgcaactttagcagatgttgggatagaagttaacacagtagttcaaattgatttcgcacttcatggtttatagaaatgctttcacattcatatctgaatatttgaaacaacctagtgggtaggtaggtaagcaattttatctgtgtttcccatggaagaaactgaggctgggagatgttcattgtttgttatccaaggtcatatagctagtaagtagaagagtccagatgcaaacccaggccacctgaacaatgttcacatcattttaccatggagaagagattagtgcttttatttgtctaacactctggtcagtgaaattaaagtatctccgtgtgaaacagcatgcaaaaggctttgtttctaatatttttaacaaatccctttagatcgttgggaattaaacaaatacctagggcagtgtggacttacctgaagtcttttgacattttatgaagttctgttaaacctagaaataaagtcaaataaattttttattgctttagagacatagttattggaagttatttatagtttaaatatgtagccataataattattcgtgactatatttcaagatagtttattcagcaagcacttactgagaacctaccatgtactgggcactgtgttcttaaaaggactaattgatgagctcagtctagtgggggagatgagtaaaccagcaattataatacagagtactacttgagtagaggtacgcatagggaaaaccctgtaatagagggagcactgtctgtgttacctaatgcagacttgaggtaattcgaaaaggcatgttaagccatgtgatgcttgagtacaatcttgaaagcatgttaatacttaacttggtaagaacattttaagcgaataacagcctatgcaaatacacagaggcatttgagaatgcggcacttagagggagctacaaatagattgacatggcaagagtatgcactgactgttaagggatggaaggagttgagaccagagagagagagacatgattaggattgtgaagagccttagatgacatgcttttaaaaagttagtactttttcctaaagataattgggagtcattggtgaattttaatagggaaatgcttgctatccatttatgtttgcaaagattacataatagtgtggaggatggaattggtggtgcaggatatgagattggaagcaagaataccagttagttacgatagtaaccatgtcataaatgctccacgtccaaactggtactgacattagagagaaaagaaagaaatttgagaaataattagaaggttgagatttaactagtcttggtgagagagagagatagtcttcagatgtggtttggacaaatgggtggatggcgatgctggtcaaagccaatacatggttgaaaaagccggtttctgtggctagagggtgttgatgagctcagtttgagatattttgagttgaaggtacctgtgggaatttacggttagaaataactgttaggaggctgggcatggtgtctcacatctgtaatcccagcagtttggaggctgaggtgaacagattgcttgagatcaggaattttgagaccagcctggtcaaagtggtgaaaccccatgtctactaaaaattcaaaaattagctgacatggtggcgggcgcctgtaatcccagctgcttgggatgctggcttgaacctgggaggtggagtttgcactgagccaagatcacgtcactcactccagcctgggcgacagagcaagtctcaataaagaa

SEQ ID NO: 32188 - DNA, 473 bp, Homo sapiens
attttgtaataacagaccactgcatattgtacaattaagttttttcaacaattttaaggcaggattcacagtaaacacttttttcttttaaaaaattatttttaaggaatagagacagtctcaccatgttgcttggctggccttgaacttctaggctcaggcaatcctcctacctcagcctcccaaagtgcttgaattataggcatgagccaccacacccagcccacagtaacatttctaatgtggcagatgtagttacattgacaaaaatttttctggtaaaggccaggtgtggtggctcactcctgtaatcccagcactttgggaggctgaggcaggtggatcacttgaggccatgggttcgagatcagcctggtcaacatggcaaaaccccgtctctactaaaaatacaaaaattagctggtgtggtggtgtgtgcctgtaatcccagctacctgagaggctgaggcatg

SEQ ID NO: 32189 - DNA, 415 bp, Homo sapiens
aacctccgtctcctgggttcaagcgattttcttgcctcagcctcctgaatagctggggctacaggcatgtgccaccaggcctgtctaatttttgtatttctagtagagactgggttttaccatgttggccaagctggtctcaaactcctgacctcaagtgatccatccgcctcagcctcccaaaatgctcggcctcccaaatctgttttagtggtacaggtactcatgcacatgagtaccgctcctggccttggcactctttatacgttgtaaacattgattgtttttgtctttaatatattttagaaatattttccctagtctttttgcttgtccttttaaagataggcccctgttatcatttgctgtaaatgtcatcatctgcatagaaaatccaagattatcagttgaaaaa

SEQ ID NO: 32190 - DNA, 279 bp, Homo sapiens
catctagccaaccaacatttcctggacgtatgttgccttcctgcacttctgggcccagctcctgaagagcttgtgaccgtggtggccaggaggtgcaggacctcctgcttctgagactgacctcttcccgggctttcttctctgtccaggaaggtgcctatgcccctgctgtgtgtcaactctgctgtctctgcagccatctcaggagttcagagagctcattttccctcttcttatatcaaagtttcctgtgtgttaacaatgaaagataccaaaact

SEQ ID NO: 32191 - DNA, 940 bp, Homo sapiens
gaggcgtgggtgttcggctacgtcactggggccctacggtgcctggagctgggcagtcttctcgtcagagtggggactggtaagagcgacctccccgccaggtcctgtgtgttgccagccgaagaagggtagctgaaaaattcagacccagcacagtgtttatgttggtcaaaaatagaaaactatgtctggcgccgccgaggcgggaggacccttcaggccaagagcagcctagcaacatggcgcaaccccatctctgtagtcctacctcagctccccccagctgaggggggctcagccccccagccctcaagtatgaacccaacggttcaaggctccagtgagctatgatcccatcacagcattccagcctgcgagattgaggacacaaagaccaacgagccaccacagctaccagtcccagaacccgctaatgctggggaacggaaaatgagggagttcaactctggcaagttctcagcgaaatccacgaccttttcctttatcttctggactctcaatgtgactgatgaaagttaccacatgctctgcagggggaaatggtttagcatgtattactacatcttaatcacatctttgtaaaaggccaggagcattttgaaagtcacgttcacagacattgtttaaacatagtctgtatataccaaagtataggacgttgtatcatctcatattaattagttagttggctcaaaattagtgctaatgacttagtaattcagtgatttctgttagctttaaaacctttatttcagaactatttcacctcttggttttcatttttgctgtgtgtcactgcctgccagctgctaatttattaactcccagtgaatcacgtgtcctgtgaagggactgaatattagtggcaaattatgttgatgatttatattttgaataaatagtttgaatacatagaaca

SEQ ID NO: 32192 - DNA, 1061 bp, Homo sapiens
ctccgctgccagccccgaacacggatatatctgtgttcggggttgtgggccttcaggccagggcactgcccatgacttcggagaagccacctggtgttccaggtgctgctggctgaggctcctgcagctcaggctgggcctctttccaggccagagacttctccaatttggttttaaaaagcaatccgtgacctgggcagtcttctcgtcagagtggggactggtaagagcgacctccccgccaggtcctgtgtgttgccagccgaagaagggtagctgaaaaattcagacccagcacagtgtttatgttggtcaaaaatagaaaactatgtctggcgccgccgaggcgggaggacccttcaggccaagagcagcctagcaacatggcgcaaccccatctctgtagtcctacctcagctccccccagccctcaagtatgaacccaacggttcaaggctccagtgagctatgatcccatcacagcattccagcctgcgagattgaggacacaaagaccaacgagccaccacagctaccagtcccagaacccgctaatgctggggaacggaaaatgagggagttcaactctggcaagttctcagcgaaatccacgaccttttcctttatcttctggactctcaatgtgactgatgaaagttaccacatgctctgcagggggaaatggtttagcatgtattactacatcttaatcacatctttgtaaaaggccaggagcattttgaaagtcacgttcacagacattgtttaaacatagtctgtatataccaaagtataggacgttgtatcatctcatattaattagttagttggctcaaaattagtgctaatgacttagtaattcagtgatttctgttagctttaaaacctttatttcagaactatttcacctcttggttttcatttttgctgtgtgtcactgcctgccagctgctaatttattaactcccagtgaatcacgtgtcctgtgaagggactgaatattagtggcaaattatgttgatgatttatattttgaataaatagtttgaatacatagaaca

SEQ ID NO: 32193 - DNA, 1086 bp, Homo sapiens
ctccgctgccagccccgaacacggatatatctgtgttcggggttgtgggccttcaggccagggcactgcccatgacttcggagaagccacctggtgttccaggtgctgctggctgaggctcctgcagctcaggctgggcctctttccaggccagagacttctccaatttggttttaaaaagcaatccgtgacctgggcagtcttctcgtcagagtggggactggtaagagcgacctccccgccaggtcctgtgtgttgccagccgaagaagggtagctgaaaaattcagacccagcacagtgtttatgttggtcaaaaatagaaaactatgtctggcgccgccgaggcgggaggacccttcaggccaagagcagcctagcaacatggcgcaaccccatctctgtagtcctacctcagctccccccagccctcaagtatgaacccaacggttcaaggctccagtgagctatgatcccatcacagcattccagcctgcgagattgagatgatgattattccccaccttctaggacacaaagaccaacgagccaccacagctaccagtcccagaacccgctaatgctggggaacggaaaatgagggagttcaactctggcaagttctcagcgaaatccacgaccttttcctttatcttctggactctcaatgtgactgatgaaagttaccacatgctctgcagggggaaatggtttagcatgtattactacatcttaatcacatctttgtaaaaggccaggagcattttgaaagtcacgttcacagacattgtttaaacatagtctgtatataccaaagtataggacgttgtatcatctcatattaattagttagttggctcaaaattagtgctaatgacttagtaattcagtgatttctgttagctttaaaacctttatttcagaactatttcacctcttggttttcatttttgctgtgtgtcactgcctgccagctgctaatttattaactcccagtgaatcacgtgtcctgtgaagggactgaatattagtggcaaattatgttgatgatttatattttgaataaatagtttgaatacatagaaca

SEQ ID NO: 32194 - DNA, 264 bp, Homo sapiens
caggtgcccatctcctataaagtcccctttgaaaacagaacattagccttagattttagtgttctgctagtatcattcacaaataccatggctagccttgcacggtgcttggcctttgtaggtacggtccacacattcctaagtgaaaattatagtcaacttaggatcatgagatgttaaaatacagtgaaccattgtgttccaaatattatataatttgaagaaactactatgcccttgaaactaggaattctttgattctta

SEQ ID NO: 32195 - DNA, 580 bp, Homo sapiens
agaggccccggggagaaacccaccctgccgacaccttgatttctgacttccagcctccagaactgcgaggaaagaagccgctcttgtttctggcaccctgtctgtggctctttgttacaacagcactagcaaacgagtacagtgttcatatttaaaatcttcacaaatgccgatgcctgtcgaaccaaaacaaaatagtctgtttgccaccacagcccggacctgtgaagtttcaaatgatagaagtcacttagtaaaagctgcctgcagactttcccccctggctggaccaggaatcttggggtggaggtttttggatgttgaccaagccagcttggaaaaggggaataacatgagaactctgcttaaacttggaaagattatcttcccctggatgctgtcttgcattgtttttaaataataataatgataccggctggtttgaatgcttactgtgctgggtgtggatctacgtgcctcacatgtatcagtgactctacttctcacaaactctgtggatgccctgtttttacagatgcggaaagtgaggcatagagagatataaaaatagttaaagaaa

SEQ ID NO: 32196 - DNA, 391 bp, Homo sapiens
acttgggttgccacccagttgagcaggttctccaaatgcctgaagatctgcctcagtatgaagcacaaaggcctcccctgcaccaggatctttgcacaggaaagacagcatggctgaaactgctagttcatttgagcaagtgcttcaaatgcctggtgatttggataatgtccaaaatgtctaggtgtggagtagagagggccctactgcaccatgatctacacacaagaagatccacctgctgatccgggtgaaggagtacttcaaatgtctggagatttacctgggggtggagcataccaggttctaatatggtttgggtctgtgttcccacccaaatctcaagtcatacggtaatacccaatattggagttggagctcagtgggaggt

SEQ ID NO: 32197 - DNA, 359 bp, Homo sapiens
gccgacctactactactaaattaacggccggtcgaccattgaacggaattgaatggaatcgtcaacgaatgaattgaatgattccatttgattccatttgatgttgattccattcgattccattttatgatgattccatgcaattccattagatgatgactcctttcatttccattcgatgatgattccattcgtttccatccgatgatgattccattcgattccgttcaatgatgattgccttccagtccatggattattccattccattccattagatgattccattcgggtccgttcgaagattctcttcgattccattcgataattccgtttttctccgtttggtgttgatacca

SEQ ID NO: 32198 - DNA, 1135 bp, Homo sapiens
gtatctcaatttttaaaaattctcaaattgtttttttttttgttattgtaaaatactcaaatttccctggcttatgtttctttagttttattttcattactgtgttacccaggtttgttattcataatatgatgaatcgtaaaatacagtgatatgactggtataaatgtttctctgtaatttttaatggccttgttttagttattatatgtagttgtttctaaagtgtttgttacagcttatttttgaaacagattcttacattcatgaactagtcttgaagaagacagttctgaaaattttattatcctaatcttttcagtgtactaaaacattactcttatgtattgcagattataaagtagcttatatacaaggagtagtaggtactagggaaatgtttcattttgcataatgaaacattttgcataatgagtggctggattcaatggttttttttttgttccttttgtacagtttggtttcaatgacaaattataaaaatgatattgttcttacatgtgttttgattattttcagtttgtcttgatgtttgtggataatagttaaacttattttcaagtttaaaatattttacaaacttgctatgcaaagtggttttaaaaatctcatttctaagcagttttatttaattatgtatggttcatcaaaatatatgttaacaaaatataagataactgaggaaaattaattgccatttgtatattccttagtaccagattatcgttgattatgtgtaatggagagagaataaatagctgaaacctaatattcttccagttttttttatgctgccggtttggatcttttttaatcagtccccttttcaaaagtattaccatgtcatgatttgaattgcatttttaaagttttcttatatacatatatttaagatcatagtaaactcccaaatacagtagagggggtaaaatccatatgctaatctgcattagaatatataaagttagatgacctttttaagaatacaaatataggctgggtgtggtggctgacactataatcatagcactttgggaggccaaggcgggcagattgcttgagtccaggagtttgagaccagtctgggcaaagatggcaaaaccctgtctctaca

SEQ ID NO: 32199 - DNA, 836 bp, Homo sapiens
  misc_feature (1)..(1): n is a, c, g, or t
  misc_feature (61)..(61): n is a, c, g, or t
  misc_feature (64)..(64): n is a, c, g, or t
  misc_feature (69)..(69): n is a, c, g, or t
  misc_feature (78)..(78): n is a, c, g, or t
  misc_feature (80)..(80): n is a, c, g, or t
  misc_feature (86)..(86): n is a, c, g, or t
  misc_feature (94)..(94): n is a, c, g, or t
  misc_feature (109)..(109): n is a, c, g, or t
  misc_feature (111)..(111): n is a, c, g, or t
  misc_feature (117)..(118): n is a, c, g, or t
  misc_feature (122)..(122): n is a, c, g, or t
  misc_feature (127)..(127): n is a, c, g, or t
  misc_feature (129)..(129): n is a, c, g, or t
  misc_feature (135)..(135): n is a, c, g, or t
  misc_feature (138)..(138): n is a, c, g, or t
  misc_feature (140)..(140): n is a, c, g, or t
  misc_feature (144)..(144): n is a, c, g, or t
  misc_feature (147)..(147): n is a, c, g, or t
  misc_feature (159)..(160): n is a, c, g, or t
  misc_feature (163)..(165): n is a, c, g, or t
  misc_feature (167)..(167): n is a, c, g, or t
  misc_feature (174)..(174): n is a, c, g, or t
  misc_feature (182)..(183): n is a, c, g, or t
  misc_feature (185)..(185): n is a, c, g, or t
  misc_feature (193)..(193): n is a, c, g, or t
  misc_feature (203)..(203): n is a, c, g, or t
  misc_feature (208)..(208): n is a, c, g, or t
  misc_feature (216)..(216): n is a, c, g, or t
  misc_feature (219)..(219): n is a, c, g, or t
nggcgtcggggccgggaaggattatcgaccacgaagcgtgttaagtaatggaaaataaaanatnagtcnaaaagcctncnacgtcnttcgactntcaatattagaaatngnctcctnnccgntttangngcaggnggngncganaanaaaggaataatnnagnnntntagaaanaagttatnnantgccagcncccttctccnccagntaataaanacncatgtgttttgattattttcagtttgtcttgatgtttgtggataatagttaaacttattttcaagtttaaaatattttacaaacttgctatgcaaagtggttttaaaaatctcatttctaagcagttttatttaattatgtatggttcatcaaaatatatgttaacaaaatataagataactgaggaaaattaattgccatttgtatattccttagtaccagattatcgttgattatgtgtaatggagagagaataaatagctgaaacctaatattcttccagttttttttatgctgccggtttggatcttttttaatcagtccccttttcaaaagtattaccatgtcatgatttgaattgcatttttaaagttttcttatatacatatatttaagatcatagtaaactcccaaatacagtagagggggtaaaatccatatgctaatctgcattagaatatataaagttagatgacctttttaagaatacaaatataggctgggtgtggtggctgacactataatcatagcactttgggaggccaaggcgggcagattgcttgagtccaggagtttgagaccagtctgggcaaagatggcaaaaccctgtctctaca

SEQ ID NO: 32200 - DNA, 1831 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32201 - DNA, 822 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccaggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagctcgggaggctgaggcaggagaattgcttgaacccgggaagcggaggttgcaatgagtggagatcgcacaattgcactccagcctgagcaacagtgtaagactctgtctcaaa

SEQ ID NO: 32202 - DNA, 2014 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccgggtgagcagcccccagtctcctgccaagggcactccctcttttactacaaggccccacagatgagaaggctggcctcaggcatgtcaggcagccctagcatccctgctgagtgaccctgggtgagtccttgcctcggtttccccacatggacagtggagctgaccagccacctctgcctccaggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32203 - DNA, 1719 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32204 - DNA, 1437 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32205 - DNA, 1435 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcaggcggcagggtcacggcatcacgctggtgaaaacagtaccgacgattccaccttggttgctacgccaatcgagggaagcacaatccacgcaaggacgctggcgccacttcctccgtgggacagcaggccggaggtggctaagatcctaaccaggtcacgtggtgccgaacagagtgtgggaatcacattgggaggcggccgtttggagaacagagggttccccaccgagccctgctctgcaggggaggccgcactgaggcacccagctgtcgcacaacacgaacagccccccgcagggcgccccgcaccacgggcgcccggcacccaacgcggccagaccccgg

SEQ ID NO: 32206 - DNA, 1836 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggaggaagctgtctgaggatccctatggcatcttctgcctcgtcctgacacccaccaggggtcctgcagaattaaacaagatggccccggtgcagtggctcacacctgtaatcccagcactttgggagctccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32207 - DNA, 1737 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccgatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32208 - DNA, 1623 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccaggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32209 - DNA, 1586 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttgacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32210 - DNA, 442 bp, Homo sapiens
gtacgggagctgggaggcgggggaagccccagcatgggaccctagcagctttggaccacctgcccagccctgcctctcatgctctgtcccccagacatggtggcccaggcgctggagctctctcggaaaccacacgtggtcatcgccacgccggggcgcctggcagatcacctgcgcagctccaacacttttagtataaagaagatccgcttcctggtgagttcgccccgcccctgcagacctcaggagctgggctcggagcctccaggcccaatgtcagagcctggggcaccatctcatccatttaggaaacgtatgtccgttagactgtccagtaaaacgctaggaacagtgacaaggaccgttcaaggaccaacaagagggggcccagtcctagcaatgttattcgggggtagggccttgctgagacttgggtgagggg

SEQ ID NO: 32211 - DNA, 351 bp, Homo sapiens
cctcagtctcccaaagtgctgggattacaggcatgagccaccgtgcctggcctgctgcctctcctttctaagctgcatgaggccactgtgctaggtgtctcaggggcgggtgggggcaggaacaccttcccagaacctgagagctggaggggttgacaggcacatccttcccgccgacctgccagattctgtgcatgatgctgcgcaaattcagcttccccaccgtggctctgcactccatgatgaagcagaggtgaggccaccctggggcccgccagcctcaccctgggataccttccccgcctcagacattggccccgatccttccttctgccgggcgccttcttcctg

SEQ ID NO: 32212 - DNA, 1936 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccaggggtcctgcagaattaaacaagatggccccggtgcagtggctcacacctgtaatcccagcactttgggagctccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccgtggagctgaccagccacctctgcctccaggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32213 - DNA, 2094 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctcaaaaaaaaaaaaaaaaaaaaaaaaaaaaaaaaaaaaaaaaaaaaaaaaaaaaaaaaaaaaaaaaaaaaaaaaaaaaaagaaaaaacaaacaaaaaaacaacaaaagagaggggggcgcgcgcgcggcgaaatagacgctctctccccccacgcgggcgcggcgacacaaaaaaggagacacggcgcgacccccagcacgagtcattcaggacaggaccagaggagggggcccccaaaagaggagagagggagcatattataccg

SEQ ID NO: 32214 - DNA, 1742 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttccccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32215 - DNA, 1755 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaaaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32216 - DNA, 1907 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccaggggtcctgcagaattaaacaagatggccccggtgcagtggctcacacctgtaatcccagcactttgggagctccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32217 - DNA, 1745 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32218 - DNA, 1595 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagcttgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctca

SEQ ID NO: 32219 - DNA, 1030 bp, Homo sapiens
  misc_feature (4)..(4): n is a, c, g, or t
  misc_feature (7)..(7): n is a, c, g, or t
ggcncgnggccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagctcgggaggctgaggcaggagaattgcttgaacccgggaagcggaggttgcaatgagtggagatcgcacaattgcactccagcctgagcaacagtgtaagactctgtctcaaa

SEQ ID NO: 32220 - DNA, 1526 bp, Homo sapiens
agactccgtctcaaaaaaaaaaaaaaaaaaaaaaagagaaaaggattatcccctacaaaatgtcagaggttcctgctatatgaaagagcaagtaggtatgctcaagaaagacaaacagagaaaaagagaaacaggcaagatcaagaaacagatcatgagtttctgattttgctgctttccagttggttcttaactgtgggaacttagtgaaattggttattagttcttagactcctagaacctgaggattttagatttgacgggatgcccaaatttacctagtctgactagtcagttctaaccttcctttttctgacaagtgactgtcaagcctaacaatcaaatctctttcttttaaagcacaccttctaggcagggacaggagctcattttccacaccatctttgtcaactctcatagaaagttttccttgtatcgagctcaaatctgcctcctggaaattcttcttcttcttccctccctgttggtaccagctctgctgtcagagacttcacagtctgtgctccctctgccctgtgacgtcttcagactatttgagaacaggaatcatgactcctgggacttgccttttctctaggtcaaatacctctataattccatctgctgttcttcatagggtcttctccctatcctgcccttttcctccaatccatcttttaactgctcttgagcagtctaactgagaagtatgattcaaagcaaaataaatcttaaggtggcatgactctgaaaaaattgagaaaattgaactcagagatcccgatcccaacccctttctcctgggagtgaaaccttagtttctaccagagagtgtgggaaaccacttctggtggaagccccttaattaaatacctgaggaaaaaaataaaagaaactcagagacccagaataaattagctcattattctagcttgcttggccacagggacatattttgttttggctgaaataatgacatggaactggcagtgattccagaaaacctttcttctctatcatggcctgaatcctcagccacctcaaaagtcagcgggcaggaggagtctctcgccagttttcttttcatttcaaatgaggctcattgtcctagaaaagtaattaactagcaaccagtccaatgactaaataaaaggaccatccagctgtggctcacacctgtaatcccagcactttggaaagccaaggcaggaggaacacttgaggccaggagtttgagaccagcctgggcaatgtggtcaaattctatccctacaaaaaaaaaaattagccagatgtgatggtgcatgcctgtagtcccagctacttgggaggctgaggcaggaggattgcttgagcccaagaatttgaggttgcagtgagctgtaattatgccactgcattccagtctgggtgacagagtaagaataagaccctgtctctctgtctctctttctctctttttttttttaaaggagtcagctctacaaagatgttgctttctttgatgcaatgcagagagcagagct

SEQ ID NO: 32221 - DNA, 497 bp, Homo sapiens
agactccgtctcaaaaaaaaaaaaaaaaaaaaaaagagaaaaggattatcccctacaaaatgtcagaggttcctgctatatgaaagagcaagtaggtatgctcaagaaagacaaacagagaaaaagagaaacaggcaagatcaagaaacagatcatgagtttctgattttgctgctttccagttggttcttaactgtgggaacttagtgaaattggttattagttcttagactcctagaacctgaggattttagatttgacgggatgcccaaatttacctagtctgactagtcagttctaaccttcctttttctgacaagtgactgtcaagcctaacaatcaaatctctttcttttaaagcacaccttctaggcagggacaggaatcacaagctccgggtggataaggcagctgctgcagcagcggcactacaagccataatcagatgagaaggcggcggttgcaggcaagaagcctgtggtagtaagaaaggaaag

SEQ ID NO: 32222 - DNA, 1026 bp, Homo sapiens
agctcaggggtttgcaagtcagatatggccaaaggatgggcaaagctgaaggtgctgatgatgagtggccgaactgagcaaccacagacaggatagagaggaagcaaggtcaagggatgcaggaaatggagggatggagatctggatgcaggcaaagagcagatgtcatgggatgcaagggtgagaactagaaggacgagaagtggtggtcaccgagtgggatgctgggatgtgagctttcagaggtggaatagctccgaatgatggaaatgggttgctgagtgtagtggagaatgaaagtcactggagttgaggagctgtagagtgtcagatgagtcatccaaatgaaacagatattgctcaagaaagcaagaagggaatcaggcgctaaaggcttccatgattatgagggaagtggctcagggtcaggaaatgacagagaaaaggaaagggagacaaccacaggtatttaccagtgcaatattcagtttgaccatagaacccagggtggatagggtaaaggagactcacaggaggtatggctaccatggtaagttgggccagaatcagaaagatctttgaatgtcaggctaagaagcctagacttaacaggaaggcaatagggagcaactgaaggttgctaagcaactatcagaggtatactttggaaagataatagaggaaacagcactgggcttggagtcagaagacctgggttcaataataaacagcagctaccatttattgtgcacttactctgtgcaggccactgtgctaagcactctagggggattgtcttatccattcccacactggactcagttcagtcaggtcttaagctgtatgatcttaggtaagaaaaccctacccctcccctctctggactcagttgtcccatctgtcagtgggagtgagactgggctagactgtccccaaagggcccttctaactcagtcattctagggcagtgtggccctgaggcttgaagggcctcaccctcttaccggatggaattcaagagactta

SEQ ID NO: 32223 - DNA, 440 bp, Homo sapiens
gaagtttttgtttctaacttttattttaggtttatgggtacatgtgaaggtttgttacctatgtaaacatatcatgcggttttgttgtacatatcatttgatcatctaggtattaagcccagtatcaaaaaattatcttttctgctccctccatcctctcaccctccctgctcaagtagactccattgtctgtcgtttccttgtgttcctaagtcatcatttagctccaacttgttgagaacatgcagtataagttaatgcttactctctttaacatctttcacattagaaatctatggagaagaaatatgaaagactcatatataaacatggggcaaaccatgaagctaaatcttaatgtatcccaaaccccagagggagcataaggttaactttgggtggccagggtgcttagtgataacattatgagctttctacat

SEQ ID NO: 32224 - DNA, 377 bp, Homo sapiens
atttcataatgtctatacttgctttgtcaagggtaaaagtatcctaaaagtaagagtgaaacatttcatcactggttttctttggtgtatgtcgttgttattcttatatactaaaggtaaataagcttaagcaccaatcttgtatctgagtgctaatagcttgtgttctcattttattcaatgagtatctattatgtgtttattatatattcagcaatttcccagatcctgggaagtacaatataaaaagtacgcatggtctctgcccttaagaggttataatacttttgaagaggagtaaaactttgagactactataatttcgggcacaagttgaagtaggaactgactatacagccaaaattcaaagaagaaaa

SEQ ID NO: 32225 - DNA, 594 bp, Homo sapiens
actggatttggggtaaatttacaggctggagacagaagaatggatgtgtatttagctttcaaattgactattgttttatgtgaatgtctgataaagaaaacacaatggctgccagatggggcctgggagtgagatttcccatgtggagaattctagaagacatgcctggagttctggagcctggatcctctggacagacaggtggccagctaaccagggtggaggcaccaaagataactgtggggtggggagaagacaccagcccaagagatttgactgggattggtctacgcaagaatggaaaatggaggcagaatgagttagcagcaagcacacgtacactgctatagaatctgagggacccggccagtgctggccaatagaaatagaatgtgagccacagacataatttaaacttttcttgtagtcacttaaaaacatggtaaatctatgaaatagaagattgctcgtgcaaataaatgaactctgctttggtctcagtgatcaggggtcccacactcaagtgccctcaatacccagagaagtaactgaaataaatggaacagatagggtgtgagcaaagttcacacgttc

SEQ ID NO: 32226 - DNA, 437 bp, Homo sapiens
cggcgtggtggcaggagcccgtaatcccagctactcgggaggctgaagcaggagaatggctggaacccaggaggcggaggttgcagtgggccgagatcgcgccaccgcactccaagtgagccttcatctcagaaaaaaagaagaaaacagattcaaagtcactaactccatactatctcaaatatacacttgtagggcctccactctattctccacagggatgccaaagtgacctccaaatcgccttgctcctctgctaacaatattttggctctctcttctgctgtcagataaggctatacacttcccttttagcttagcaaggctggtccttcaaaatctagaccagacacacctttgcaggctcatctcgagtcattcccactgttccagtaacaccttatcactagccttaccctaacacttgacacctcagt

SEQ ID NO: 32227 - DNA, 416 bp, Homo sapiens
cacaggtacccacaaaagcagatgcagagggacaggtggggtggccacctggcctgcccccatggcctggaagttcccttttcctccacggcctacagctgcacatccccagggcagcatcctcttgcctgggctcacagagatgctgccacttacaaccagaagagcctgcccggagcagtaacctccgagggccccggatgcagaaggactggccagttctctctcgaaaagaggaagaggcctcctagaaaaatgggcatttcagtggagtcttaacactaagccgcagctatctgtgtaaagaacagcaggaaagaataggagtgtgttcagagaaaggcaggaggccaaggtggctaaagatggggcatgtggaagtggggcctccaaaaaaagcctgcaaaaggaggcta

SEQ ID NO: 32228 - DNA, 342 bp, Homo sapiens
tttaaacttcttgcttgtttgaccttatattttattagagaggccaagagtatttaaacattactttgccatgttctttctcagattgtcctgccatccacagagtaaatcaggggctcctccaggcattttaatttgttgaaaacaaagaaaattaaactttttatagatgattcagcttgcatggtggaaaccattttgtattggagacagagagtgagtgctggggagcactttcagttaagaataagtagatcagggctactagtgcttgtttatatggtgtgaatgtttcaattttaaatttcgatcatttggagtttagaatctttaagaggatga

SEQ ID NO: 32229 - DNA, 657 bp, Homo sapiens
aataaaatatacaccgagtatgcctctcttgcctccccttccatctcttttacctcttccctctctgccacccctgatacaaagaccaatctctcctcctcctcagctactcaacatgaagataacgaggatgaagacctttatgagatctacctccacttaatgaatagtaaatatattttctctcccttatgattttcctaatattttcttttctctagcttactttactgtaagaatacagtatataagatatataatagccaggaatggtggctcatgcctgtaactttttttaattgggaagaagaatggcattatcttacatttttacaaatctctttagcatctagcttaatagaagacaactggacactcatatctgcgcctgcattcaatatatgacaatacattgccttggtttgaagcgtgaaaatctaacttcacacagatatggacagatgctcctagacttataatgggtggggtttacatcctgataaaccacttgtaagttgaaaatattgtaggttgaaaatgcatttaatacatctaatctgctaacatcatagattagtgtagcctaccttaaacatgttcagaacacttacatcagcctacagttgtgcaaaatcatctaacacaaagcctatttta

SEQ ID NO: 32230 - DNA, 592 bp, Homo sapiens
ggcgacagaacgccgccagattgttcaaatctgaacattctaaacggggaaatcggggcgcggaagagtggggtgggaaacgaacaccgggttgcggaccagaactcagggtcaggtacgccaaggagaggaagtgaggcgaggccagccccacgccaccagccaggggccgctttcctctaccagagaggggtagccagccgcagcccaaaggccacccagggtgccagatggacagcgaggcctgctgattggttctcgccgggtgccaatgagcccgggcgccttcaggtgctatggcaacgaggcgtacgtgcggaaacacatgatggccagggtggaaggggagtaacggggtttaggttggtacggtactgggttatgctctgtgccgcactgcgagcccttggcgggcacagccgccagggtgggagaagcgtaccagaagcagctccagaatggcagccccagctggctgggcagcctgcgccgcctgggttaacagggcgagggaatgggcgtctcggtgccgcctttgctagagctctgcccaaacccggtttccatccgtgtatctctggggtgacaacca

SEQ ID NO: 32231 - DNA, 574 bp, Homo sapiens
ggcgacagaacgccgccagattgttcaaatctgaacattctaaacggggaaatcggggcgcggaagagtggggtgggaaacgaacaccgggttgcggaccagaactcagggtcaggtacgccaaggagaggaagtgaggcgaggccagccccacgccaccagccaggggccgctttcctctaccagagaggggtagccagccgcagcccaaaggccacccagggtgccagatggacagcgaggcctgctgattggttctcgccgggtgccaatgagcccgggcgccttcaggtgctatggcaacgaggcgtacgtgcggaaacacatgatggccagggtggaaggaacaggatctcatcatgttgtccagactgcttgaactcctggcttcaagcgaccctcctccctcggcctctcaaagttctgggataacaggcatgacccaccgtacatgcatgggcatgatctgattttttttttaattaaagttgtcacagttatcaaagtctcattactgtttaacacacattttaccactcctttcctaaataaaccctctaacccagcaacacga

SEQ ID NO: 32232 - DNA, 358 bp, Homo sapiens
taaagatggggtttcaccatgttagccaggatggtcttgatctcctgacctcatgatctgcccgcctcaacctcccaaagtgctgggtacattttaatatctggtagtgtcagaactccagataacttcccctgccctgctcttcttttacacaagtttccaaaatattcttgtgtgttcatttttcaacaccaaccttacagccagtttatttagttaaaaaaaaaaaatcagttagcatttaaatttagttttagactgacaagagagaaatgacatctttataaaaataattcttcttagtaaaggtcatagtttgtctctctgaagagttttaaagttttcttctcattggccc

SEQ ID NO: 32233 - DNA, 270 bp, Homo sapiens
aaattaatgctggaaggttgtgtctaaattgcaaaaaggaggggtataatgaaatgcacctggccgggcgcagtggctcatggctataatcccagcactttgggaggctgaggtgggcagatcaggaggtcaagagattgagaccatcctgggcaacatggtgaaactaaaaaaaaaaaaaacaaacttaggtgggcatggtggtgcgcacctgtagtctcagctacttgggaggctgaggcaggaaaattgcttgaacccgggaggcgg

SEQ ID NO: 32234 - DNA, 483 bp, Homo sapiens
ccaagggtcagtcagagctagtaagcggtttattcgggggtacgttggcatcgggtgccaggcttggagagctcccgactattgcattttccccacttccaaaggtccagcttcgggttcttgtaccaacactctgcatcttctgttgccttcatgcagcacttgtcacatttgctgcctttacccactgggaatgtcaaaggctttggagttcagactgggattcaaattctggctctgccaggttaggatggaaggatatgattcggggcaaattacccattttctccaagccccagttttttggatctgtgaaatgaggacagtgttgcgtagatttgcaatcagtgttattgtgggttgatgtgtgtcctccccaaacttgtatgttgaagccccaacccctagtacttcagtctctgactttacttggagataggatccttaaaaaggtaatcaagttaaagcgaggccatcagggtg

SEQ ID NO: 32235 - DNA, 551 bp, Homo sapiens
aaccgtggcataccacaagttcaaaaatggcttgtgttgaggcaattatctcatcacaataaataacagtaaatcaatccacactaattgccttttgtgcaagcttagaagactctttagcgttctctgattattgatttgttatcgcttgtgtcaaaaatgcagtatttccagagaatatattgcacactcttagacaggattttaatttaacataaaacaatccaatttccttttttttccagaggtgctttaaacatctaaaatagaatgaagctgaagatggcactaagaggtttttagcagagactttgcatttcaaaccaatttaacaaatggcccctgttaccaccaccacatggccctgccatgcatcccgctcccaaccccacccgccacgttcaaaattaacaagaaaaccatgtgtaatctcagattcctcattttcttgcaaatttggaactgaaaagcaagacaaacaccaccaacagaaactctatgctttacttctttccctctgccccttggttcagtagtttccactgaacctg

SEQ ID NO: 32236 - DNA, 499 bp, Homo sapiens
cgaatttttttccttcacaatttcatgtatagatttgatctttgtaacctccgcatacaattttttttcattccttattaagtcaagaactttcaccttcaagcaatttacagcttctctttggcatatccaaatagctgtcattgctacttttggacttagggactgtcattaagtaaaataagggttacttaaaactcaagcattgccctgccccatagtcagtctgacaatctgataactgagatggctactaagtgacaaatggctggtagtttatacaggtgaatacattagacggaggggagattcactacccggtcaggtgagatttcatcaggctactcagaatggcgcacagtttaaaacattgttgtggtcacgcctgtaatcctggcactttgggagattgaggcaggaggattgcttgaggccaggcattcaagaccagcctgggcaatgtagtgggaccccccatccccccaccatctctagaaaa

SEQ ID NO: 32237 - DNA, 433 bp, Homo sapiens
gctagagtgcaatggtgtgatctcagctcattgcaacctctgccttgtgagttcaagtgattctcctgcctcggcctacccagtagttgggattacaggcgcctgcctccatgcccagctaatttttgggtttgttttttttttcttctgagacagagcaaggctgtttcaaaaaaaaaaaaagaattaaattaaaaaataaaaaagcagtaaatccaaaagaatacctgcaacttttaggctggcaaaggtctgttggtttctaaaaagcaagagttattttcaaaaaatggacaaattagactttgtcagattttaaaacttgcactcatcaaatgataccgttacaagaacatgagccaggaagcctcagactgggagaaaatacttgtaatacaaagaacttgtatgtagaatatacaaaggactctta

SEQ ID NO: 32238 - DNA, 608 bp, Homo sapiens
gtatgtctgaaatatctctcatgtctttaaatatctttctaacttaacattcagtaatcatttactattttactttgatattctgtgtgtaattatgctgtcagcttttctggactcaaaagtgctctcagatgtcacctctggtatacaaaaaaaacagttctgtatattacctgagcagtttcttgtccacctgccatgttgtgagtaacatcacccaatctagaggccagaagaggcccaagtttggataatacagcccctgttcaccctggaagcttgtctggaggggccagggtaggctcagaatgagactgaatactctgagcacccactgtctgatcctagatcacaatccccccatccagagttagctaatctatgaggctcatgggtatggtctgcatagaagaccaccctcacttctgacaccactgcaagcttggtggggattcctcaaaccgccctcaggttcaacagttcactagagccaggcatggtgactcatgcctataatcccagcaccttgggaagctaaggtgggaagctcacttgaggccaggagttcaagaccagcctgggaaatatagtgagacgcaatctctaca

SEQ ID NO: 32239 - DNA, 475 bp, Homo sapiens
aatctactttcttcccctatggattttcccaggagcactttttaagttgagtctggtatttaacttcttcctgctttattttcccatctcaaagtaaatataacaagtttcagtctaccccacagctttgggagggaggaagctttgttaaagtcagaatactttgaacttcgtggtggctcatgcctgtaatcccagcactttaggaggccaaggtgggtggatcactggaggtcaggagtttgagaccagcctggccaacatggcgaaaccccatctctaccaaaacacaaaaagcaaaacaacaacaacaacaacaaaacaaagatttgctgggcatggtggcctgtagtcccagtatttgggaggttgaggtgggagaatcacttgaacccagaaggtggaggttgcagtgagctgagattgtgccacactgcactccagcctgggtgacaaagtgagaccctgtctcaaa

SEQ ID NO: 32240 - DNA, 1844 bp, Homo sapiens
cattgtgacattgagcccaacacacacgcttgacaccagactagacttgtcacagggccaaacccaacagccacatgccatagcttcactgcattttcagctacacctttggaggccaccttctcctatcaactgtggaaagccagaagggctcccttctccattctccttccctttttcaagtctaatagtgaaatctcctgcttaccccagcagtaaatagttgccttcctaccccttacctgggggccgataatttgagatactttgttttttcaatgcgtcagttgaaggatttagtttcttaaaagcaagaaatgttggagtgttgaatttttaaatagaatctcttttcatgtttgaatgattgttattagttctagaagcattctctttgtcatgacccgattatgtatactcttgggtttaggaaggacaaaagtgatgaaatttgcatgagatagaataaatatcttaggaggagtgaaagaacctgaggaagagacacgaccctaagggaatgaatgcataagcagtcttctcagtagcccagagtttccaggaaacaggaatatttatatcccttgcccactcttaaaatacatagatacataaaaaggcagtctctgtagacaacacatgcacacacccacacaaaacataattcctggggcttcctttttctgaatgttaatccattttatcgagcagtgattcccaaactttgagattttcagattttatgctctcgtctgttagattttatgacattctatcatcctaaaaaatgtactatatgtgttatatgtatatataagttaaagcaacttgaaattgacttggtttggcattgtctcaagaaccctagatatcattattgataccatggggaatcatagaaataaagttgaatatcattgatctgagagtaggatccagaaataagtagtttcagttcctgatcagttaagcctcaagtgtttgagtaaccaacacagcaagacttgggaaatgcagtgagcacccgaggaaaggaaagtggtagtctttgcctgcatttcagcatgcattttcctttcctactcagttgctatcttccacttaaataccctcatttgaccctaggaagttttttgtttttttttttagtttgagacttaaaaccagatttatttgttgttgtagagagatttccacagaagttgtgttttagggacctccatcatctttgtgggggtacagatatttatgtgtaaatatcattttatgtgatttccaaattttcgagggaaacatttcaattcccagttcaacaaaaggttaaatactaattgactcaatgaccaccttcaggaaagttaaatagtaaattaggttaaattttgactggtgcttagacatttcctagttatattaacttaagcagacagcagcacattaacctgagttacacctgtgaggaaatgaccttctaaatttgattttgtttttcatctccagggccttaataagagtgtgttaacacacgactattttacaatgatagctctaaataatttattttttatttcaagaaagagaaatacaccttagaaaaacaaaacccaagattttattttatttttaaagccatatttttgtgctagtagcatttagattattccgtatgtgagatccgtatcagcatttcattacctgggtttgttctaaagaagatttatttttgttctgtgaataatttttgacagttcttgtacatgtacagatatagatacgtttgaggtcttttattgatattcctacaaagaatacaaataaactttaactttaaacaaaaaaaaaaa

SEQ ID NO: 32241 - DNA, 1790 bp, Homo sapiens
cattgtgacattgagcccaacacacacgcttgacaccagactagacttgtcacagggccaaacccaacagccacatgccatagcttcactgcattttcagctacacctttggaggccaccttctcctatcaactgtggaaagccagaagggctcccttctccattctccttccctttttcaagtctaatagtgaaatctcctgcttaccccagcagtaaatagttgccttcctaccccttacctgggggccgataatttgagatactttgttttttcaatgcgtcagttgaaggatttagtttcttaaaagcaagaaatgttggagtgttgaatttttaaatagaatctcttttcatgtttgaatgattgttattagttctagaagcattctctttgtcatgacccgattatgtatactcttgggtttaggaaggacaaaagtgatgaaatttgcatgagatagaataaatatcttaggaggagtgaaagaacctgaggaagagacacgaccctaagggaatgaatgcataagcagtcttctcagtagcccagagtttccaggaaacaggaatatttatatcccttgcccactcttaaaatacatagatacataaaaaggcagtctctgtagacaacacatgcacacacccacacaaaacataattcctggggcttcctttttctgaatgttaatccattttatcgagcagtgattcccaaactttgagattttcagattttatgctctcgtctgttagattttatgacattctatcatcctaaattggtttggcattgtctcaagaaccctagatatcattattgataccatggggaatcatagaaataaagttgaatatcattgatctgagagtaggatccagaaataagtagtttcagttcctgatcagttaagcctcaagtgtttgagtaaccaacacagcaagacttgggaaatgcagtgagcacccgaggaaaggaaagtggtagtctttgcctgcatttcagcatgcattttcctttcctactcagttgctatcttccacttaaataccctcatttgaccctaggaagttttttgtttttttttttagtttgagacttaaaaccagatttatttgttgttgtagagagatttccacagaagttgtgttttagggacctccatcatctttgtgggggtacagatatttatgtgtaaatatcattttatgtgatttccaaattttcgagggaaacatttcaattcccagttcaacaaaaggttaaatactaattgactcaatgaccaccttcaggaaagttaaatagtaaattaggttaaattttgactggtgcttagacatttcctagttatattaacttaagcagacagcagcacattaacctgagttacacctgtgaggaaatgaccttctaaatttgattttgtttttcatctccagggccttaataagagtgtgttaacacacgactattttacaatgatagctctaaataatttattttttatttcaagaaagagaaatacaccttagaaaaacaaaacccaagattttattttatttttaaagccatatttttgtgctagtagcatttagattattccgtatgtgagatccgtatcagcatttcattacctgggtttgttctaaagaagatttatttttgttctgtgaataatttttgacagttcttgtacatgtacagatatagatacgtttgaggtcttttattgatattcctacaaagaatacaaataaactttaactttaaacaaaaaaaaaaa

SEQ ID NO: 32242 - DNA, 1790 bp, Homo sapiens
cattgtgacattgagcccaacacacacgcttgacaccagactagacttgtcacagggccaaacccaacagccacatgccatagcttcactgcattttcagctacacctttggaggccaccttctcctatcaactgtggaaagccagaagggctcccttctccattctccttccctttttcaagtctaatagtgaaatctcctgcttaccccagcagtaaatagttgccttcctaccccttacctgggggccgataatttgagatactttgttttttcaatgcgtcagttgaaggatttagtttcttaaaagcaagaaatgttggagtgttgaatttttaaatagaatctcttttcatgtttgaatgattgttattagttctagaagcattctctttgtcatgacccgattatgtatactcttgggtttaggaaggacaaaagtgatgaaatttgcatgagatagaataaatatcttaggaggagtgaaagaacctgaggaagagacacgaccctaagggaatgaatgcataagcagtcttctcagtagcccagagtttccaggaaacaggaatatttatatcccttgcccactcttaaaatacatagatacataaaaaggcagtctctgtagacaacacatgcacacacccacacaaaacataattcctggggcttcctttttctgaatgttaatccattttatcgagcagtgattcccaaactttgagattttcagattttatgctctcgtctgttagattttatgacattctatcatcctaaaaaatgtactatatgtgttatatgtatatataagttaaagcaacttgaaattgacttggtttggcattgtctcaagaaccctagatatcattattgataccatggggaatcatagaaataaagttgaatatcattgatctgagagtaggatccaacacagcaagacttgggaaatgcagtgagcacccgaggaaaggaaagtggtagtctttgcctgcatttcagcatgcattttcctttcctactcagttgctatcttccacttaaataccctcatttgaccctaggaagttttttgtttttttttttagtttgagacttaaaaccagatttatttgttgttgtagagagatttccacagaagttgtgttttagggacctccatcatctttgtgggggtacagatatttatgtgtaaatatcattttatgtgatttccaaattttcgagggaaacatttcaattcccagttcaacaaaaggttaaatactaattgactcaatgaccaccttcaggaaagttaaatagtaaattaggttaaattttgactggtgcttagacatttcctagttatattaacttaagcagacagcagcacattaacctgagttacacctgtgaggaaatgaccttctaaatttgattttgtttttcatctccagggccttaataagagtgtgttaacacacgactattttacaatgatagctctaaataatttattttttatttcaagaaagagaaatacaccttagaaaaacaaaacccaagattttattttatttttaaagccatatttttgtgctagtagcatttagattattccgtatgtgagatccgtatcagcatttcattacctgggtttgttctaaagaagatttatttttgttctgtgaataatttttgacagttcttgtacatgtacagatatagatacgtttgaggtcttttattgatattcctacaaagaatacaaataaactttaactttaaacaaaaaaaaaaa

SEQ ID NO: 32243 - DNA, 1790 bp, Homo sapiens
cattgtgacattgagcccaacacacacgcttgacaccagactagacttgtcacagggccaaacccaacagccacatgccatagcttcactgcattttcagctacacctttggaggccaccttctcctatcaactgtggaaagccagaagggctcccttctccattctccttccctttttcaagtctaatagtgaaatctcctgcttaccccagcagtaaatagttgccttcctaccccttacctgggggccgataatttgagatactttgttttttcaatgcgtcagttgaaggatttagtttcttaaaagcaagaaatgttggagtgttgaatttttaaatagaatctcttttcatgtttgaatgattgttattagttctagaagcattctctttgtcatgacccgattatgtatactcttgggtttaggaaggacaaaagtgatgaaatttgcatgagatagaataaatatcttaggaggagtgaaagaacctgaggaagagacacgaccctaagggaatgaatgcataagcagtcttctcagtagcccagagtttccaggaaacaggaatatttatatcccttgcccactcttaaaatacatagatacataaaaaggcagtctctgtagacaacacatgcacacacccacacaaaacataattcctggggcttcctttttctgaatgttaatccattttatcgagcagtgattcccaaactttgagattttcagattttatgctctcgtctgttagattttatgacattctatcatcctaaaaaatgtactatatgtgttatatgtatatataagttaaagcaacttgaaattgacttggtttggcattgtctcaagaaccctagatatcattattgataccatggggaatcatagaaataaagttgaatatcattgatctgagagtaggatccagaaataagtagtttcagttcctgatcagttaagcctcaagtgtttgagtaaccaacacagcaagacttgggaaatgcagtgagcacccgaggaaaggaaagtggtagtctttgcctgcatttcagcatgcattttcctttcctactcagttgctatcttccacttaaataccctcatttgaccctaggaagttttttgtttttttttttagtttgagacttggacctccatcatctttgtgggggtacagatatttatgtgtaaatatcattttatgtgatttccaaattttcgagggaaacatttcaattcccagttcaacaaaaggttaaatactaattgactcaatgaccaccttcaggaaagttaaatagtaaattaggttaaattttgactggtgcttagacatttcctagttatattaacttaagcagacagcagcacattaacctgagttacacctgtgaggaaatgaccttctaaatttgattttgtttttcatctccagggccttaataagagtgtgttaacacacgactattttacaatgatagctctaaataatttattttttatttcaagaaagagaaatacaccttagaaaaacaaaacccaagattttattttatttttaaagccatatttttgtgctagtagcatttagattattccgtatgtgagatccgtatcagcatttcattacctgggtttgttctaaagaagatttatttttgttctgtgaataatttttgacagttcttgtacatgtacagatatagatacgtttgaggtcttttattgatattcctacaaagaatacaaataaactttaactttaaacaaaaaaaaaaa

SEQ ID NO: 32244 - DNA, 558 bp, Homo sapiens
ataagaggaggacaggtgtttgaaaaaaaaaggctacttgctgtttttcctcaacagccctttggcttgctaattttgtatattgttaccttttttccccgtctataacttttctttatccttcttcactgatagatgttcattcatgaaactgatagttcttaaatgtattggtgtaaataactttacttctggctcacatttgaagaagtatcattccttcactggaaggaattagtaacagtttggctttgttagcttgtgcttaaggtaaggttttagatgttcctatggtttgacagcttctgaaatataataatacctaagtggatcacctgaggtcaggagttcgagactagcctggccaacacggtgaaacaccgtctctactaaaaatacagaaattagctgggtgtggaggtgtatgcctgtagtcccagctacttaggaggctgaggcaggagaactgcttgaacccaggaggaggaggtcgcagtgagccaagatcacgccactgtactacagcctgggtgacagagtgggactccatctcaaaaa

SEQ ID NO: 32245 - DNA, 444 bp, Homo sapiens
ttaaatcctcacttcatccctgatgtgtcttgactcaactgggctacatcaacactcccttttaagactggaactacatcctccagagtacctttccttaaatagttctgggttagacatggccaataagagaaatgcatatgagattttgaaagtggatgtgaaatagacatctttattctgcaggtataggcagacacatgtgcagctggaggattcacagtggccttccagcaagctttttatactcaggcaacagtgatttgagactctctggtaggtgagttaataaaccagagaaaagcaaaacctccacagactctccttgaagtggaagtcaaggagatgactttcacttggagatgagaagattgagacagctcaggaatggcagccttgcaggagtgatagccagccagccagccagccagccagccagccatg

SEQ ID NO: 32246 - DNA, 320 bp, Homo sapiens
tacaggtgcatgccaccacacccagctaatttttttgtattttttggtagagatggggttttaccatgttggccaggtttcaggggtacatttaaccaaggaagttaaagatctgcatgtatactgacaactataaaatattgattaaggaaattaaagattatgcaaataaatggacagatatctcatgtttatggattggaaggattaatattgttaagatgtttataatccctaaagcaatctacagattcaatgcaatctccatcaaaattccaatgtcattcctcacagaaatagaaaaaaacaatcctaaaatg

SEQ ID NO: 32247 - DNA, 161 bp, Homo sapiens
ccaggctgtacagaaaataaataaattagccaagtgtggtggtacacacctatgttcccagccacttgggagattgaggtaggggaggatagcttgaacctgggaggtcaagcctgcaataagcagtgattgtgccactgcactccagcctgaatgacaga

SEQ ID NO: 32248 - DNA, 649 bp, Homo sapiens
acaggagacagaattggacaacaaggattttaagagtcattgcccattgtaaagcattaagccagagctggttattcattatcagactaactacatactagtccatgctagtgtcagcctatattaaaatagtctttccttgccatagtgctggcgaaaacccaatcccttctgatgaaacattgcttcttgggaagacaagctgaggaaagcaatgaagatcccagtgtcggcctttattgagctatgtatgagggtcagggtccctcaactcctagtgactatgaagcagcagtgtgatggcttcgccctctttgcccctctgtcatcaatcctttgcatgtggctattttaagcttctcagctttcttttgggaggcttcatgtgtaacttattatagaaatgttactgaaaagctgcctaaacaaaaaattgtataaagtaggaatttgtataaagtaatactgttgtaaatccatcttcaagatgtaaagaatcaatttgtaaagtgtatattttcacttctcccttcaaatttatgtgaacaagtttttcatgtttcaatattgcttacataggaatacaccttacgtttttatcagtataaatggaacatttaaaaccagtcaacaacagaacagataatcc

SEQ ID NO: 32249 - DNA, 428 bp, Homo sapiens
tatgtttccaaatataccccataaaaatatcttaatgaatatcagtagtttctaactatttatattttgaggcttttttggagtctaattcagatttatttagaaacaagggtatcagcagttggtaagcaactgaatatttctttttttttcagactttatgtcataagccatctttagtctttgtctcttactgaacattaatgggacaactctctttgttgtatttttttatggttgtatacaggccacttaacgaagccttttcttgctgtcacttctctaagggtatgacttgagactcgctctgtaactgtgagtcagctggtttgaacttccacaaaaggaagcagagaaacaagtagagccaggctgctgaactcttacaacccagacatgccaagcctggacatcttgcacttggagct

SEQ ID NO: 32250 - DNA, 724 bp, Homo sapiens
ttttttttttttaacaatggatattctgtaaaatatcctgtacaaaacaagactattgccagtaatgtatacaaattgtctttttgtgtacttccagcataggtttggatatatgaacatttttcttttattgttttatcttcacagaaaataaaaggtgttaatttgctttttaaaacaaatttaattatcacattttaaattactttgtggactgtgttttcaaaactttgcaaattcatctgttacacagaaaattttgacttaaaacatctgctgaattccaaatttctgtaatagctactgtatctgtgataaactttcctatatctttccttgccatttctatggattttataatgaaagaaaaaggcattggagactgaaggcagaaatggttgtgacagtgctgtttggctttttcattcttcaaatgccaagtcatccactttgttttcctgtttaggctttgcacaaatacaattgctttcaggaatcctaaagcagcattttattgagtttgaattattaaaggtacagaggaaatgtggtgatgtagaacttttcctaacacaggtatctaggaagtaagtgctgagttgattttctaggttcttacgtatttgaaaaataaaattgcaattcgagataagtgcttgagcactctacttaagtattctctgtgttttatgaagagaaaatgatctgattttcccttatactt

SEQ ID NO: 32251 - DNA, 756 bp, Homo sapiens
ctgcgctggcctagcagggtgttggtgtcttgagcccgaatcctgtgcagcattggcccaacccttgcaggtggccgccacccctttcccctgcagctggcatagccaaggtgccaggctctgcaaagggtaagctgcatctgaattgggcacgaggggatggttgtgccttccacatctccttttgtgaaagatcttcccagatgcaaacccaggatggacttgccaaagagaaatcccagtaactggctctaatctctgtgccaccagctgccattgtctcgaagttcatttgcaaacaacagaaaccaactgtggctgggttaagtgggaagtttattaaacaatattggataggtcacatggtcaccaggctaagcggctccctagccaggaccaagatcccatgtcattctccagtactcccaggttcataccccaggacttacaccacagacacccccaatgctgggcactgtcactgggaccactgcctctgctcttttggaaactaaatgtagaggcttctacttgtcaccaaaagggattttaaacagccactagctgccacttcaaggtctcaggcaagcatactgcctcggctgagggagaggttagaaaaaacagcatccagccaggcgtagtggcttgtgcctgtaatcctggcgctttgggaggcctaggcaggaggtctcgagcccaggagctagagaccagcctaggcaacaatgtgaaaccctccctacaaaaaataaa

SEQ ID NO: 32252 - DNA, 939 bp, Homo sapiens
atgatgattaaaaaaaatgcaagttcggaagacttctttattctacttggattttctaattggcctcagctggaagtagttctctttgtggttatcttgatcttctacctgatgacactgacaggaaacctgttcatcatcatcctgtcatacgtggactcccatctccacacaccaatgtacttcttcctttcaaacctctcatttctggatctctgccacaccaccagctctatccctcagttgctggtgaatctccggggcccggaaaagaccatctcgtatgctggttgcatggttcaactttactttgttcttgcactgggaatcgcagagtgtgtcctactggtggtgatgtcgtatgatcgttatgtagctgtgtgtagacctttgcattacactgtcctcatgcaccctcgtttctgccacttgttggctgcggcttcttgggtaattggttttactatctcagcacttcattcctcctttactttctgggtacccctttgtggacatcgcctagtggatcacttcttctgtgaagttccagcacttctgcgtttatcatgtgttgacacccatgcaaatgagctgaccctcatggtcatgagctccatttttgttctcatacctctcattctgattctcactgcctatggtgccattgcccgggctgtactgagcatgcaatcaaccactgggcttcagaaagtgtttaggacatgtggagcccatcttatggttgtatctctctttttcattccagtcatgtgcatgtatctccagccaccatcagaaaattctcctgatcagggcaagttcattgccctcttttatactgttgtcacaccgagtcttaatcctctaatctacactctcagaaacaagcatgtaaaaggggcagcgaagagactattggggtgggagtgggggaagtga

SEQ ID NO: 32253 - DNA, 480 bp, Homo sapiens
atcctcacacagctggccacagccgatgcccgattctggaagggccccagtgagccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccacca

SEQ ID NO: 32254 - DNA, 342 bp, Homo sapiens
gattgtaacagaggactccataaatgatacttggcaatgccacagactcattatcatgatagggaacctgtgatatttttgggtacctgccaaatgcatttttatttacctaaggtgatttcatagacagatggccattttgaatgtttcatgtgactcactagaggaattagagctatacagagttaagaatgcttggcgtagagggaaccgtagaaccctgggactagcttagcctcttaaagttaactaaatattgtccctgccacccccatatgttatgactgtataatttttataacttacatttcctttcatttctttattcattttctaatttct

SEQ ID NO: 32255 - DNA, 577 bp, Homo sapiens
catcagctttgcaggcattatttaattgttgcacccattctccaaggtccatgttgttccagcatttgcaagtaaggaaactaggaaactgaggtttaagaagttaagttgctgaagatcacacagctggtagtaggcaatatagctagatttgaacctacctgtattgtaattcaacactagtgctcttaagcactaccatgtcccatctctacaatgctagttttgaaaaagatactatctatggtccctttcaatcttgacctacctattaacacagtggaagatttttattaagtaactcaacctaggcaatacattaaggagaaaataagtcacaataggaaagacatgtatttgtgtcttagatgaaacaatattttttattaaattgactgttttaaagtgtgtgttggggggtgcttgtgtgcatttgtattagctattctgtgtatcctattcttagtctgtggtacatggatttcttggtagagagcagatatgaaccccaattttgtatcaggtgatagtctacaggttttatcagattctctgataggtttgagggaaaaaaaaa

SEQ ID NO: 32256 - DNA, 520 bp, Homo sapiens
tggcaatagaacatagaagtgctcttggctttccaaaatctgcacatctccaacttttcttttagctagaggtggccctgtgattgatgagtgaccagccatgtgtggagaaaagcaatgtgaacaacttctgacttcgctgttaaagaaaattggtctgtcccccatttccttgcattcccattcttactggctgaaattcaaagctgataaatggagctagagcagatagctgggaaaatgagttgagggtcttacattaagacttgccagcaagaagaagaatttttccagggttcctgacaccaccaaattgttcgatcagctctgaactctatactgagattctttaagtatgagagacatgaactttgactggcttaagtgagctattgaggtctctttgctattgtgacctaactcaggggtcagcaaataacactctgtgcgcaaaatctgacctacgatctgtttttgtaactaaataaaatttcactgaaacacaaaaaatgctcattta

SEQ ID NO: 32257 - DNA, 962 bp, Homo sapiens
aacttctgctgtgctctgggaaggcattctcactctgtttatgttgtctaagtgcagacatggatgtgcaggtttgctagaacctcctgaggatgtgcaatggttctgttcatgcctgaatcagttcttttgggagtggacattctttctctccctcatgcacagcctcaggcacatggcttgagctatggcggcacgcagtatggccatcacccaggtacaccccttccctaagaagaggctcttcaggttacactcgggtactgttgttatctggcttattgtccataggatcaacatagagtcctgaggtcagttcaaaccatcaaaccagggatgttacttattatttgaaaacttctttggaaagataatcttgggttgttcagtgggaccagtctttgacgggcaaatctccagaatacatggggtcagttctctcaggttcaggaagcatgtaatctctctaagattcattaattaaaaaaaaaagacacatgcatagaaaaatagaacaaaatggaaactctttattggatacctactatgggttatgtgccagggtttcctaatcatttggggacatgtgtgtataaacaaaaccaggctatgtggccaggcagtgtgtggctcacacctgtaatcccagtgcttagggaagccaagttgcaaggatcgcttgaaaccaggagttcgagactagcctgggcaacatagtgagacccggtctctgcaaaaaaaaaaaaaaaagaaaaagaagaagaagaaagagaaaggaaggaaggaaggaaggaaagaaagaaagaaagagaaagaaagaaagaaagaaaagaaagagagagaaagaaaaagaaaggaaagaaagaaaagaaagaaagaaagaaagaaaggaagaaacaaagaaaagaaagaaagaaagaaagaaaagctaggaagctagggtgtggggcgcatgcctgtag

SEQ ID NO: 32258 - DNA, 341 bp, Homo sapiens
gcctcttccatgccttaagtccatgagaacaagtcactttctctttcctggggactgtcatcccttcatctgaaagctgagagtttgcttcaggatcctctagtgtgtgaaattgcactgaagccactgaacactgggtaattgtacaatatttctgtgtcttaacagtgatgtggcatttggttcaattctaagccatcaggccacttgttgacatgacctagagaagatggaagtgaaacaccgagtcattaaacagggaccccaaaatgccgaattgacgtgatctggctgggtccactgtgatgcggggaatcacccgtcagccccttgctggatcg

SEQ ID NO: 32259 - DNA, 2340 bp, Homo sapiens
tgagatgggttcgctctgttgcccaggctggtgtgcagtggtgcgatctcagctcactgcaacctccacctcccgggttgaagcgattgtcttgcctcagccttccaagtagctggaattacaggtgcccgccgccacacctggctaatttttgtatttttagtagagacggggcttcaccatgttggccaggctagtctcgaactcttgacctcaagtgatccacctgccttggcctccctaagtgctgggattacaggcatgagccaccacacctgtccgacagtgtagcaactttctaaaactgaaaaatctcaaaggagatcattggaactgacttgttcatttattttttgtttttaaattaagaaagattacacaaaataagtgttactgtactttaagctattacaaatatccaacttttaaagatatgtaagaatcagtaatattctagaaagcacatatatagtaaaagggcatcctttaaatgtagaacgggtaaacatgaaacagttccatgcttgaattgttaagtatctagggggtaaacattgaatgggagaatcatttattgggttaaggtcccttccttgtcattctgggatctgtgaatcacattgtaattcctgttgacaaagctttacttgttaacatcagttgatactgacattctccataaagatatagaatgaaaatatctattaaaaatagtttatcattgttttagcttttttgttttgtttgttttgagacagagtctcactgtcacccaggcttgagtgcagcggtgtgatcttggctcaatgcaacctccacctcccaggttcaatagattctcccaccttggcctcccaagtagctgggattactggcatgcaccactatgcctggccagttttttgtatttttagtagagatggggtttcaccatgttggccaggctggactcgaactcctgacctcaagtgatccgcccacctcagcctcccaaagtgccgggattataggcatgagccactgcgcctagcctgttgcagctttttaaagcaggaaaatatccatataaactgttgggttagaatctatattagaatctttcaaactaattgaaaacaggaagactatcatctaagtagccagataatctgggtttcaaaaagttattccatggtactggtttaaaaaatacttttcaagtgttttaatttttaaagtgtaactaattcttcaaatatgttatgctgttaaaatatgtattccataagtactttttgtatatgtattcttaaattttaaaaagtcaactgaatgcgcaaagatgatataattttggatgtagacatttaaactagattcccagtcctctccttcaaaagcttggtctttgtttttcctatagggaaaaaagtcaaaataagttccaaaaactatcctcaaagtagtattgtgcttgtagtaaatgaaggttggatggatggatactgacaatggtggcaggcatttcaagccttttaaattagtactttttgtcgtcttgcttattaaaattttgttaattttagcaaagaccaattgttgtgataaactggtgttttttggatgcttcaagcacacgttaaccaattttttaattccccttttggttcctcccattgttctaaaataggactttcatattattaaaacctcaaaagatgatccacccaggatgaacaaagatcaccaaggggaaagaaaacattttttatctttacagaaaacatgttaagattatatatagatgtattctttacattggatattgtattagagtcctccttacaagaaatgaaatagtttttagcactcttagcattagagttcctagattggtgttgatagctacagttttaaaatgtataacctgaaaatgaaggttaattttgcattgtaagagcacatttgatctatgtaaaaagtgtccatttggtgtatttttttaaaaaagagaaagcactttcatattaagtagcatgtgtatgaatttagattttcatatttgttgtgtctgtattcagtgaagtaaattgagcatttaaatgtttgttgatggcaacattaactattaaattaaagcaccttatactctgctgcttaacttgcttgtaattgcacctttgttacctgcacattttcatatagaatattgttgtaacattgcttcatgtgggtctggatggaagattagtgggcctacaggatcatttatttatattgtttatattacaataatatattgtagatcagttgtaagttcatttctttacaaataaaagcctcttccatttgaaaaaaaaa

SEQ ID NO: 32260 - DNA, 426 bp, Homo sapiens
atttttttaaaaatataaaaactaatttaaaaaatcaattatatgactgatgaaaattttattgctattattatattttgcatttgattctaagaaaactgtgcttctctcttttttttttttttgagacggagtctcgctctgttgcccaggctggagtgcaatagctcgatctcggctcattgcaacctccacctcccaggttcaaacgattctcctgcctcagcctctcaagtagctgggattacaggctcccgccaccacgccaggctaatttttgtatttttttagtacagacagggtttcaccatgttggccaggctggtcttgaactccctgacctcaggtgatccgcctgccttggccttccaaagtgctgggattacaggcgtgacccaccgcacccggcctgccaactgtgcctct

SEQ ID NO: 32261 - DNA, 515 bp, Homo sapiens
agatctctgaaggcctgagggtaatgggcacaaaagagcatccgcttcaagtctgtgggagaagcagtcagatcctcccccaccagccctcctccacctcagccaccttcccagaaactgacagctatgccccccaacccctaaaccccaagcaggagactggaaactcctctctagggagacttacagccccaaaataaagaattctatcactaacttctggcagtggccctcaaattggcagggtccatgctctatttcctcatggtgagactcaacacttaaagtcggccctatgcatacagggagtttccaatcgtcccattcataaccatggaaagacagccagtaatcaccagagtttcggagagaagcctctaacaaagagaatgaccaaagtagaaaacaggtgaaaaagaacgcacaggaaacagacaaggtaggaggcaaagggaaagaaacatctacgtaacaaacgtgtgcaggaatcaataaaacattaaacaaagaaatgt

SEQ ID NO: 32262 - DNA, 454 bp, Homo sapiens
ttttccctgaaaatttttccccaaagtgggggaaaaacttgcagtgaggaccaccacagaagaagctggttggactcagtctccttcctgcctgcaaccttgagaggaggcccaagaccttcgtggggtcaaaggctggagactgctactgtcctggaagaggactgtcaggacagggctgtctgtttcgctgtgttttcctttggttctaaggaacttttttcccctgtggaagcaaacccaacaatctgcatcctgagcttgagaagttaaaggcaaagtgtgtttttggcatgatcaggcttacagataaagactggtgagtaacgtgtgggcattcatacaaatgaccactcacatgaaggtggaggagatacactgttctgggactgccatgtgaggttttaaaagatgaaatgtcagaaacattaaaaaatatgtacttaaaaacatc

SEQ ID NO: 32263 - DNA, 507 bp, Homo sapiens
tcttgaatttaataataataatattgatgctattagtcatcactataactttttattgagtgtgtattttatgtcagacacagtgtggctaagtgctttacatacattatctcatctaatccttagaaaaaaccctggtgtattagtcttaatttaaaagatgtactttggaaaggttagtagtttacccaagattatgcagctagttaaaagtggtgctggggctgggcttggtggctcacacctgtaatcgcagtgctttgggagtctgaggcaggaggatcgcttgacaccaggagtttgagactaacctgggaaacatagcaagaccccatctttacgaaaaataaaaaaattagccaggagtgggggtgcacacctgtggtcccagctacttgggaggctgaggcaggaggattgcttgagccccagaggttgaggctgcagtgagccatgattatgccactgcacatctgtctgggtgacagagcaagatcctgtctccaa

SEQ ID NO: 32264 - DNA, 395 bp, Homo sapiens
aaggaaaggtctgaaattgattagagcaatatattccaggagaaatgttttgcacgaccgttctggaggagactgtcatcacactcagatgagacatgcaagcccacagtaactcacacctgacaataggacctggtaagcaggctgggccagaggcccttggtcatcccagtgctatgtggccaagtggtgggtgtctctcccttgcaaccaggtgaagaaagcatcttcaaagactatatgtccatggaaattccgctatagacttgctctaagtaggtaagagagaaaggaggagtcttcggagcaggtcctctgaggtttatccactcagggcctggaccatatcaatcacttataatatgaaaagtgtgatagatggagcaagagaggga

SEQ ID NO: 32265 - DNA, 318 bp, Homo sapiens
ccccataagaagcatgttcagtaatcattgaatgagtgctgggaacattgtttatagttgaacctagaacctcaacattttattgataataaatcacagtttattctgaagtcatttgggtctcattggtacaaataagatactaatttatggaatctacatgtaatgcctgtctggtggccatctttattaataaacattatctattgcttgttataaatagggaactgagagaggtgataaaatgcaaaaagagccagatacagctcttgctcttcagggaatcacactcattcagatgtatatgtataaattgac

SEQ ID NO: 32266 - DNA, 361 bp, Homo sapiens
aaacacctttcaagctgtagctcttaaaggccaatctgagcatttcaggctcaattaccaccgatgacttgaaacgaaaagggtgctcaacaagagggcactattaaacactaaacactattccacaggctgagaggtacgtctcagcaccaagctgaaagtaaaatggcaattctaataataccatccctaacaggcctatgtggagatcagaagtactaggtgcaaagtggtggtactcttttttaactagggtagcaataagatacatttggccatttaaattgaagtaaggcttagttgtatgatagcagcttacattagaactacaagataggaaaagataagttagttgactcaa

SEQ ID NO: 32267 - DNA, 591 bp, Homo sapiens
gtcgactaagaaactacagctatattggagcttacaagtttggagctggcaaagagcatgcaaaagaggggatgctattcattatgtcttgtttattaaagcatgcaaataaaacaaacatctatccaaatgataagcatcaatggttgtttcatattttttccaaaaacacaatgccatgaccacagttcaatcacattacaggtttacaaatagcaatattaacaccaccagttgagactacagtacttttcctccaaatgtaattatcattatgaagcagagcaaagtgcaacagacaacactacagactatttcttaaatcagcatgcaaaactactgtgtacagggcttgaaattcactagttctgccaaccaccaacaacctaagaaatgtgtcagacaacacaaatttagagtgagatcattcaaagtatacagagtcagaaaaaattgtgaaaagaagtaaagccaggatttccagtaggaatttttcactagtgatgggaatttgcttccagtttggaaactgaccaatttgtcatctatttctccatccataatggtcttccatcaatctgctttaggaaa

SEQ ID NO: 32268 - DNA, 427 bp, Homo sapiens
ctggcttgcagatggccaccttctctctgtgtcctcacatagcacagagagaggaagcaagctctgcagtgtctgttcctatagggtactaatcctatctcatgacgtccttgaaacctagttacctccagaggctccatgtccaaataacatcacattgtgggttagggtttcagtaagtgaatttgagggggacacaattttaagtcttacagcagtggctatttaaatttacattgcaattaattgaaattaaaacaatactaaaaattcagttcctcagtcacactaaccgtatttcaagtgcttaatatccaaataaggtgactgagagtgatgttcacacctgtaatcccagcactttgggaggccaagttaggaggattggttgagcccaggaaattgagaccagactgggcaacatagc

SEQ ID NO: 32269 - DNA, 172 bp, Homo sapiens
actgggaactatgttgactatttgggcaatgggatcattaaaagtccaaacctcagcatcatgcaatatgcctttgtaacaaacctgtatgtatacctcctgcatctaaaataggtaaataaaaataaataaaaatttaaaaataaaatgtgatgactaaaaataaaataaa

SEQ ID NO: 32270 - DNA, 375 bp, Homo sapiens
catagtccagtggacaccagcatcactgagttcatatactgtccataatactccatgcatgttccataaatacatctttctgggaatgagtgttggttggtttacattcattaagttaacatttcttattctggccagaatcggtggctcatgcctgtaatcccagcactttgggaggctgaggccggtggatcacttgaggtcaggagtttgagaccagcctggccaacatcctgaaaccccatctctactaaaaatacacacacacacacacacacacacatgcacacacacaagttaacctggcgtggtggcaggcacctgtaattcccaccacttgggaggctgaggcatgagaattgcttgagccgggga

SEQ ID NO: 32271 - DNA, 425 bp, Homo sapiens
ggggaagcccgatactcgcctgacttttccaccagctcccggacatccttcttctcgggcaaccctgagtagcccaacccccggcactccaaaatggtcttcagcttcttgaagctcagcgccaccggatccaccagctgggtggcaaagatgccagtttcataccacacaatggcctcaaaaaacctggccaggacgaacaggaccaggaaatagaggagcaagaaaaaaagcttcagccacatcttccctggagtctcctctctttccagagagctcggaatacgggagagagaagggtcgagggcgggggccgcggctcggtggcagcttgggcgagggccccgtgtccacgcgcgggccacccggcgccgtcactggccggccatccccggcggggaagcaggtgacgggatccgcgcggg

SEQ ID NO: 32272 - DNA, 477 bp, Homo sapiens
agccctaaacacaggattttctacaagtggacagtcaaactccccacactaaagtggcagtcatcgtttacactccatgggcttcagcagtcccagcactaacgagagagtgccctaaaagcggggagggtagagttgtacaaaacatgattcttggccaggcacggtggctcacacctgtaaccctggcactttgggaggccaaggcgggtggatcacttgagtccagttagagaccagcctgggcaacatggtgaaaccccctctctactaaaaatacaaaaattaaccaggcatggtggtgtgcgcctgtaatcccagctactctggaggctgaggcatgaaaatcgcttgaacccaggaggtggaggctgcagtgagctgagatcatcctactgcactccagcccaggtgacagcgagactgtctcaaaaaaataaataaatataaataaaaatttaaaaaaattaaaaaaaa

SEQ ID NO: 32273 - DNA, 427 bp, Homo sapiens
agccgcgtggcttagcataggccagcctgtcctgggggcgtcctgggggctgcgtggccttcacacctctgctctcacctctgcccttgtagccaccgtgtcagggtccctggttttgtctcccttcatggggccttgttgctccagacttgcaggggagtcctccttgctgtacctaccaggacctggtctgcccctcaggactgaatccgtcggtccctggaatcctgctgagctgtcatgacctagagccagtcccaggtcccaggagcctctgtccgtgtggagctgcgacccgtgcttcctgggcacccacttcttaataacatgacctgggaagttcccgtttaagacaaggaaagtaaagcatcctggagcaatggttaacaagacctgaatctaaaataaaataagttccaacaaacat

SEQ ID NO: 32274 - DNA, 403 bp, Homo sapiens
gattgcttgtgtgtaatcttaatttgtctagataaaagtgaatctgacccaaattttgccatgaaagtcattggttctttatttactatgtctccacaattaagattttgaagctaaagcagtatcatccaacatatcccactgaactaagtactaaacttatatctactaaataacaagttgttatgacttttcttcgtcttttctcttttggagaaaacttatggccttcatgttcatagacacatatgaacagataccttctatgagtaattagtaagataagcaatttttaaaaattccacagaatcctagtctgtgtttagactttatgcttagggcctttcattactgagctggattggacctcagaggttaactgtttcctgagtgtgttgggatt

SEQ ID NO: 32275 - DNA, 295 bp, Homo sapiens
tttattatattattttgagacggaatttcgctctcgtttcccaggctggagtagaattttgagatataaagttttactccacattttctttgtcactaatatttccccactattccttgcactcataagcccttattttcagaatttattgtctattatggttttaatatgtgtcccctccaaatctcatgatgaaatgtggtctccggtgttggaggagggcctggtgggaggtgtttggatcatgggggttgatacctaatgaatggcttggcaccatctccttggtaataag

SEQ ID NO: 32276 - DNA, 406 bp, Homo sapiens
tgttatggatatcttttttaatgaaatgaagaaatgtaaatacattttaaaatatattcattttgaagaaaagtaaatcaaagggacacgggcatcacacagacttgcagagttgagaggcattctggagccatctgagtgtttctctcctccctcgcaccacagtccacactgatcgtgactgactttgtccatgtctgcaccattcgatggggtgcttcttaaggacagagaccaagacttgttccctgttgtaactccggtgtccagcacacacaggatgccctcaggaaacgtggaatggatggatgggtgggtggatgatgtggtgatcagaacaggagaggcctccgtgccccctaggcttccttctctttctatgcgttacgcgacagtagtgtggtag

SEQ ID NO: 32277 - DNA, 3554 bp, Homo sapiens
cgcagtcattgtgacgcaatcccacagccttctgggaaacgtagtttatttattctccagctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagatgggggacaggacggtgcaagccggcacatcacaaaccagtggacaagtgccctggagttcaggagatggctaggactccccgctggcgtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaagcagagggtctggacaccgtcccccaagggcatttcacagaccagccaatgtttcaagcccaccttagccaggcacagtaaggcctggtgcatccttgggcaccatctacagtagccactgctgggattacaggcatgagccactggacccggcctgcttttcattgttttttactttttgttttgaaataattttagacttagagaaagttgcagaaatagtagaaaattcccatgtatctttcatctagcatctcccaatgattacatcctac

SEQ ID NO: 32278 - DNA, 3522 bp, Homo sapiens
tgctggtactggtcgcgagttttaggatctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagatgggggacaggacggtgcaagccggcacatcacaaaccagtggacaagtgccctggagttcaggagatggctaggactccccgctggcgtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaagcagagggtctggacaccgtcccccaagggcatttcacagaccagccaatgtttcaagcccaccttagccaggcacagtaaggcctggtgcatccttgggcaccatctacagtagccactgctgggattacaggcatgagccactggacccggcctgcttttcattgttttttactttttgttttgaaataattttagacttagagaaagttgcagaaatagtagaaaattcccatgtatctttcatctagcatctcccaatgattacatcctac

SEQ ID NO: 32279 - DNA, 3464 bp, Homo sapiens
cgcagtcattgtgacgcaatcccacagccttctgggaaacgtagtttatttattctccagctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaagcagagggtctggacaccgtcccccaagggcatttcacagaccagccaatgtttcaagcccaccttagccaggcacagtaaggcctggtgcatccttgggcaccatctacagtagccactgctgggattacaggcatgagccactggacccggcctgcttttcattgttttttactttttgttttgaaataattttagacttagagaaagttgcagaaatagtagaaaattcccatgtatctttcatctagcatctcccaatgattacatcctac

SEQ ID NO: 32280 - DNA, 2310 bp, Homo sapiens
cgcagtcattgtgacgcaatcccacagccttctgggaaacgtagtttatttattctccagctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatgg

SEQ ID NO: 32281 - DNA, 2479 bp, Homo sapiens
  misc_feature (2311)..(2311): n is a, c, g, or t
cgcagtcattgtgacgcaatcccacagccttctgggaaacgtagtttatttattctccagctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggncaaaaaaaaaataaaaaaaaaaaaaaaaaaaacaaaacaacaaaaaagaaaaaaaaaagcacacaaaagaaacacaaacggggggggggcgccctcaaaatattctccccacgggggcgccccaatatgagcgcgcccccccgttttttttaaaaaggggcgccccaa

SEQ ID NO: 32282 - DNA, 1602 bp, Homo sapiens
  misc_feature (1546)..(1546): n is a, c, g, or t
cgcagtcattgtgacgcaatcccacagccttctgggaaacgtagtttatttattctccagctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtgagtgatgacagtccttgattgaagcatggtttggagggcttgtcagcatgactgccggggtcttgtcatttgggcctcagataattccagcagccttgggatttgtcgttgggagcacaggtgtgcagcagggtcactgatttgtttcacataggttttgtcntaacgcgggtctccctttttggtatgaggagaaaataattaataatacaataataa

SEQ ID NO: 32283 - DNA, 2996 bp, Homo sapiens
taaggctaggtagcgaggcctgggtggtgagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaagcagagggtctggacaccgtcccccaagggcatttcacagaccagccaatgtttcaagcccaccttagccaggcacagtaaggcctggtgcatccttgggcaccatctacagtagccactgctgggattacaggcatgagccactggacccggcctgcttttcattgttttttactttttgttttgaaataattttagacttagagaaagttgcagaaatagtagaaaattcccatgtatctttcatctagcatctcccaatgattacatcctac

SEQ ID NO: 32284 - DNA, 3345 bp, Homo sapiens
tgctggtactggtcgcgagttttaggatctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcagtgtggtacaggtcctgcttgctgctggggctgatccaaaccttggagatgatttcagcagtgtttacaagactgccaaggaacagggaatccattctttggaagtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaagcagagggtctggacaccgtcccccaagggcatttcacagaccagccaatgtttcaagcccaccttagccaggcacagtaaggcctggtgcatccttgggcaccatctacagtagccactgctgggattacaggcatgagccactggacccggcctgcttttcattgttttttactttttgttttgaaataattttagacttagagaaagttgcagaaatagtagaaaattcccatgtatctttcatctagcatctcccaatgattacatcctac

SEQ ID NO: 32285 - DNA, 3292 bp, Homo sapiens
tgctggtactggtcgcgagttttaggatctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggagatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagatgggggacaggacggtgcaagccggcacatcacaaaccagtggacaagtgccctggagttcaggagatggctaggactccccgctggcgtcctgatcacccgagaggatgacttcaacaacaggctgaacaaccgcgccagtttcaagggctgcacggccttgcactatgctgttcttgctgatgactaccgcactgtcaaggagctgcttgatggaggttcctccagagaattgagccctcattctccaaggcatccatcgtacacagggattaacttctctcccagggatctcaaatggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaagcagagggtctggacaccgtcccccaagggcatttcacagaccagccaatgtttcaagcccaccttagccaggcacagtaaggcctggtgcatccttgggcaccatctacagtagccactgctgggattacaggcatgagccactggacccggcctgcttttcattgttttttactttttgttttgaaataattttagacttagagaaagttgcagaaatagtagaaaattcccatgtatctttcatctagcatctcccaatgattacatcctac

SEQ ID NO: 32286 - DNA, 2481 bp, Homo sapiens
tgttatggatatcttttttaatgaaatgaagaaatgtaaatacattttaaaatatattcattttgaagaaaagtaaatcaaagggacacgggcatcacacagacttgcagagttgagaggcattctggagccatctgagtgtttctctcctccctcgcaccacagtccacactgatcgtgactgactttgtccatgtctgcaccattcgatggggtgcttcttaaggacagagaccaagacttgttccctgttgtaactccggtgtccagcacacacaggatgccctcaggaaacgtggaatggatggatgggtgggtggatgatgtggtgatcagaacaggagaggcctccggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaagcagagggtctggacaccgtcccccaagggcatttcacagaccagccaatgtttcaagcccaccttagccaggcacagtaaggcctggtgcatccttgggcaccatctacagtagccactgctgggattacaggcatgagccactggacccggcctgcttttcattgttttttactttttgttttgaaataattttagacttagagaaagttgcagaaatagtagaaaattcccatgtatctttcatctagcatctcccaatgattacatcctac

SEQ ID NO: 32287 - DNA, 2052 bp, Homo sapiens
gaggagtctttgtattgagtggcatgtgatcaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaagcagagggtctggacaccgtcccccaagggcatttcacagaccagccaatgtttcaagcccaccttagccaggcacagtaaggcctggtgcatccttgggcaccatctacagtagccactgctgggattacaggcatgagccactggacccggcctgcttttcattgttttttactttttgttttgaaataattttagacttagagaaagttgcagaaatagtagaaaattcccatgtatctttcatctagcatctcccaatgattacatcctac

SEQ ID NO: 32288 - DNA, 1743 bp, Homo sapiens
tccttgtaatccaagcagtcgcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaagcagagggtctggacaccgtcccccaagggcatttcacagaccagccaatgtttcaagcccaccttagccaggcacagtaaggcctggtgcatccttgggcaccatctacagtagccactgctgggattacaggcatgagccactggacccggcctgcttttcattgttttttactttttgttttgaaataattttagacttagagaaagttgcagaaatagtagaaaattcccatgtatctttcatctagcatctcccaatgattacatcctac

SEQ ID NO: 32289 - DNA, 1800 bp, Homo sapiens
cctgagctggggaagagcccccttacccaccacaccatcttctggaccaacgctcagaaccagtccttctctctccactcccgagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaagcagagggtctggacaccgtcccccaagggcatttcacagaccagccaatgtttcaagcccaccttagccaggcacagtaaggcctggtgcatccttgggcaccatctacagtagccactgctgggattacaggcatgagccactggacccggcctgcttttcattgttttttactttttgttttgaaataattttagacttagagaaagttgcagaaatagtagaaaattcccatgtatctttcatctagcatctcccaatgattacatcctac

SEQ ID NO: 32290 - DNA, 935 bp, Homo sapiens
tgctggtactggtcgcgagttttaggatctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcagaaacagatgtgctttgcttcattctgctgcagtacaggagtacgggtatggaaactgacccttgctgaccctggaatcacctgttggctactgcgaagggctgccgggctgcgactttccccttttggcagggcatttgcagagcagcaatgttgggaatccactcttccatcccccaggggatgccactaccatattccattgagctgccaggcattgattatttagttctttcaaatacatgtttttctaatagcaattaaacacccatcccaaaaatacagaaagtaattgaactt

SEQ ID NO: 32291 - DNA, 1340 bp, Homo sapiens
tgatcctatgaggaggtagcaggcctgagactgtatagagatgagcggcatgaggggaagataagtcagttgccatgccacagccaaggggcctttagttggaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaagcagagggtctggacaccgtcccccaagggcatttcacagaccagccaatgtttcaagcccaccttagccaggcacagtaaggcctggtgcatccttgggcaccatctacagtagccactgctgggattacaggcatgagccactggacccggcctgcttttcattgttttttactttttgttttgaaataattttagacttagagaaagttgcagaaatagtagaaaattcccatgtatctttcatctagcatctcccaatgattacatcctac

SEQ ID NO: 32292 - DNA, 619 bp, Homo sapiens
  misc_feature (563)..(563): n is a, c, g, or t
tgttatggatatcttttttaatgaaatgaagaaatgtaaatacattttaaaatatattcattttgaagaaaagtaaatcaaagggacacgggcatcacacagacttgcagagttgagaggcattctggagccatctgagtgtttctctcctccctcgcaccacagtccacactgatcgtgactgactttgtccatgtctgcaccattcgatggggtgcttcttaaggacagagaccaagacttgttccctgttgtaactccggtgtccagcacacacaggatgccctcaggaaacgtggaatggatggatgggtgggtggatgatgtggtgatcagaacaggagaggcctccggcttcatcaggctggacatgtccgagttccaggagcgacacgaggtgagtgatgacagtccttgattgaagcatggtttggagggcttgtcagcatgactgccggggtcttgtcatttgggcctcagataattccagcagccttgggatttgtcgttgggagcacaggtgtgcagcagggtcactgatttgtttcacataggttttgtcntaacgcgggtctccctttttggtatgaggagaaaataattaataatacaataataa

SEQ ID NO: 32293 - DNA, 614 bp, Homo sapiens
cccaaagttccctgaatgtggggaataagcagtttatgattcttctccacaggggatgtccagataagtgacaagatcaccatctcaaagaacttcaaggagaatgtgattcgccctatcctgaaagtaagaggtctttcttggcacttcctgctggagcctaaggttgggggagggtgatcttagccatcctaaagatctggaagccccataatttccccagtcttcccctggtgtctggtaatttccctaacccgctctgggtcactgagctcatcccacccctaacctggcccttcaggctcacttccggagggatgagtttctgggacggatcaatgagatcgtctacttcctccccttctgccactcggagctcatccaactcgtcaacaaggaactaaacttctgggccaagagagtaagagggaactgcccatgggtgggggcgggatagccagccactggaaatctggaacactggactgggggcacccccacacacataaaaggtggagcacagtggtgtggggccagtggccctggcctcaggccagagtggcaagagatggaaagcagtgggccacatgcaggcatgcttctatctgacccat

SEQ ID NO: 32294 - DNA, 988 bp, Homo sapiens
  misc_feature (839)..(839): n is a, c, g, or t
  misc_feature (889)..(889): n is a, c, g, or t
  misc_feature (937)..(937): n is a, c, g, or t
  misc_feature (953)..(953): n is a, c, g, or t
  misc_feature (973)..(973): n is a, c, g, or t
gggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgggcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctaacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagacttggatggaaacttcctgccctctctggtaccttcctactggagcttgatggttatattagggactggggtataattnattttaataatggtggcttggaaacatttttgagaaattaaaaaaatggnaagggggtggaaggttctttgcttactttttactggctatatatatangggggcacttttaacntaatgcaagggggcaggggntcacgttttttggaa

SEQ ID NO: 32295 - DNA, 372 bp, Homo sapiens
cctaggaaatgctccctgataaatttgaagaacataatgctttccatgtggttaggggaggattgaggattacctcacaacaaaagaccagcaagaataaggtatggaagcatggaatgcctgtccatatcaggggactgggaacagtaaaggacaaattgagttaaaggtgtataggagcaactgaacaggatgctccagaggtagattaaggaaataatatttgaggcctacataaataacagtggactttattttatggacagtggaaaatcattgagcatttccaatcgtaggaacaaatacacatttcagaatgacagtaattggaagcagtgtagaaagagattgaaaagaagaaagactaggggc

SEQ ID NO: 32296 - DNA, 965 bp, Homo sapiens
aacctgggaggcggaggttgcagtgagccgagatcgcgtcattgcactccaacctgggcaaaaagagcgaaactctgtctcaaaaaaagaaaaaacgaccccccgtcttttaccttacaaccagccccaagcatctcccagcctaatccagggggaccagcttcccccgcaaaggtgggacctgggagtcgacccctccctatccaggcccctttccacgtttgactgcactgaatgtgccaagaccaggagctggcttttctgggctctggctgacaggagaagctctggggttttccaagtgcattcctggctggaataaggaggtcctgcagagtcccagctgctgctctctgccaggttccgggaggggcatggtgacaggggcttaagcctataactgctggtgatctgacagccaaaagaaaaccctgatgagagattcctgcctggcaaagagttgcccaaggagaagggtgggacagggtgttggctgctttccttcaggaaaaattcttccaccccagctccaagacgccaggattggacagaacaggctggcgagctggcagagtgcctgcccagtacacaaccttggtgctactccaaagaacattgtctatcgagacctgaatcatacccttctcgagtctatgctcagcgctcctccccattcctccccatctcagttgctcacaggtagacctattggagcaaggtagcttttatttctggaaaatccatcgtaaccatcaaacttgataaacagctggcatttgaggaatcattggagtcttcctttcattccccccacaccccccgcagagctccccatccccacccccagtctcttgtcctttttcagaagaggagttgccaaggggaagggaccagtaacattgaatgactgcttgttgtcggaccccactagctctttacataaatgatgtcatcctctcaactat

SEQ ID NO: 32297 - DNA, 714 bp, Homo sapiens
ttgaattttgttttaaatagtagacacccctttatcttctcctagatttacttgttaaccattttgtcacatttgctttctccctgtatccatattcttcagaattttttcctagttttaaactctagcttgtgtgattttaatactgcttctcctgttccctctttttttgaattacctgatatttcttatgtttgttgtgtatgtctcttgaaaatggcagatttctgtattttaatgctttacctaattggatagtttttaagataatagcacttatattgatttgattttcccttctttaccgatttattttacatttttattttctctgtttcttactgttgcttattatcaacttgtgattcattcccttaccccgcctcccagttaatgtggaaattttgttataatgtcttgtttcattaatatagttaatacaggttgagcatccctaatctgaaaatccaaaacttgaaatgcttcaaaatctgaaacttttgagtactgacatgacccacaaagtggaaaattccactcctggtctcatgtgataagttacagtcaaaacttttgtttcatgcacaaaattattaaaaagattgtataaaattatcttagattatgtgtataaagtttatatgaaacataaatgaatttcatgtttagacttgggtcccatccccaagataggataatattccagaatctgga

SEQ ID NO: 32298 - DNA, 408 bp, Homo sapiens
ttgaattttgttttaaatagtagacacccctttatcttctcctagatttacttgttaaccattttgtcacatttgctttctccctgtatccatattcttcagaattttttcctagttttaaactctagcttgtgtgattttaatactgcttctcctgttccctctttttttgaattacctgatatttcttatgtttgttgtgtatgtctcttgaaaatggcagatttctgtattttaatgctttacctaattggatagtttttaagataatagcacttatattgatttgattttcccttctttaccgatttattttacatttttattttctctgtttcttactgttgcttattatcaacttgtgattcattcccatccccaagataggataatattccagaatctgga

SEQ ID NO: 32299 - DNA, 576 bp, Homo sapiens
atgaactatgactctgaaacagaaagtcatttctatgtattctaataaatcattttaatttataattatgatattcttattaacaggatattctgggttatatactctgcttgttttcaactttaaatcactgatttaaaagaacacatttttatcaatgacttaaaaagcactcaagatcatcattatgaacatatatatactcctctgttgcagaggaaatatcctcacaaccaaaatttatgtgtgatctaaattttaaacgcaccctagacaccctaataaagttagggcagggggaaaaaaaaatgaggctaccatcaataggacaggtataaaagtctggaaaccagctcctcatatatgggttgttagttaaatcacaagtctttaccagatattgttagcctagtttcaatgatttttctttaaaaatattctattatttaaacttatcaccaattaagcctactttcactctcacccatccctactcctgttcaaataaagtattactaccagagccatttttaaagtgttcaaactaaatgatattaaaaggaagttaagaaaaaa

SEQ ID NO: 32300 - DNA, 419 bp, Homo sapiens
gccatgttagccaggatggtctcagtctcctgacctcatgatcatctgcctcggcctccgaaagtactgggattacaggcatgagccaccacgcctggcctagtatacttttaatactaaaaatgtaataccaaaaaagtaaggaaaaaagttttattcacccaaagtgatagggatggcctttctaattttaaagcataaaaaccgtggaagaaatcacaaaaaatagttgattgatttgacattaaaaattgtaaaactattctgcatgccaaatacataaacaaaacagaaggccacaatggcaaacaatatctgcaacaaacttgaaaaaaatggcacagtttaaagaattcatgcaaaatctctttgttttaaaaaaaactaggtcggggctgggcacggtggctcacacctgt

SEQ ID NO: 32301 - DNA, 420 bp, Homo sapiens
caagcctggccacaagcaagctctgaggtctcaactgtttcctttgaaaaatggaaacaaagccacctgccctacttacccttagagagttactctgagataatagatgagaaaaatgctttgaaaaggataggccaggtgcggtggctcacacctgtaatcccagcactttgggaggccgaggtgggcagatcgtttgagtccaggtgttcaagaccagcctggaaaacatggtgaaaccttgtctctactaaaaatgtagtttaaaaaatttagcggggcatagtggtacgcacctgtggtcccagctactcgggggctgaggtgggaggatcacttgagcccaggaggtcatagctgcaatgagccgtgatcatgccactgtactctagcctgggcgacagagtgagaccaagtctc

SEQ ID NO: 32302 - DNA, 369 bp, Homo sapiens
aacaatcctcccaccttagcctcctgagtagctgggactacaggtgcatgccaccatgcccagctaattttcgtattttctttgtagagatggggtctcactgtgttgcccaggttggtctcaaactcctggcctcaagtgatcctcccaccttggcctccctaagcactgggattacaggtgtgagccactgtgtccagtcaagaataagttaatgaattttatcctacaacagatatagactctattctggactaaatgggaggccatcattgcctagaacacctgacctcctgaagcagattttaaaaatttgagattttggaaaatgccaaaattagacagcaacttgaaatttagtagacacct

SEQ ID NO: 32303 - DNA, 1266 bp, Homo sapiens
gagctgaaggtaggaaattccaacattctgaagtcttcagcaaatcttagcagatcatctcctcctcacagtcctgtctttagagaacagggtcgatatttcggcttctgcgaactcagatgtcatcttttcttccctaaagtttttaaagttcctattgatatattcccctgcctagagggtttggtggtcgttttcttcctcttaactttattaaggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 32304 - DNA, 449 bp, Homo sapiens
ggccgaagcctggtcagacaaagttttaatgaacgtttttgtcacgtgtgaatagtgagacatgggaaacaagttatacctcctttcaattacaagtagttagcagggcaggttcgcagggtcagcaaacagcaggccagctgatggtggtgctcccaaaataagagagcatcactttaatttttccattcttaatttgaatataaagccactcagtttgtatttggcctgtacaattactgcctcttttagctgttgaggaaattccttctttcaagccaaaggtaatctggaaaactttaactctatcagttgtgagaatgttgttactttatgagaatatttacgatgtgaaaataatggatcacaacttgaggacgtctcagagtggacttcagaattgaggtggagatgcagaggtggcatctggagcacactccatggctctt

SEQ ID NO: 32305 - DNA, 373 bp, Homo sapiens
aaagaaagaaataaaaaaagaaaagtttcataggctgacaggaaaaaaaagtctaaaaaggatattaagggagtgataatgaaaaaaaaaattgaaggccgggtgaggtggctcgtgcctgtaatcccagcagtttgggaggccaaggcaggcagatccacttgagatcaggagttcaagaccagcctggccaaaacatggtgaaaccccgtctctactaaaaatacaaaaattagccatgcccagtggcatgtgcctgtaatcccaactactcggggaggcaggagaatcacttgaacctgagagacagaggctgtagtgagatgtgatcgtaccactgcgccccagcctgggagacagcgcaagactccgt

SEQ ID NO: 32306 - DNA, 314 bp, Homo sapiens
gcatgaaaaggagtgggcccatcactgcaggccttgaaggcggagcggggaggagtgatgaggaacgtgggtcaccttaaggaacagaggctcccagctgacggtaagaaaatggggacctgagtcttacacctaccaggaactggatcctgccaacaacatgagtgagtctggaagcagggggtctttgcagactttcccggtaggaactcagccagccaacatcttggttttcgccatgtgaaaccagccaagctagcccacacttctaacctatggactgtgagataataaattcatgttgttttaagcca

SEQ ID NO: 32307 - DNA, 447 bp, Homo sapiens
catttagggtaaaataccaaaggtaccagaagaagacacagctctgactgcaagtattatcagagcctttcccaccctccccaaggaaccccatcctgttgcagttgctagaatggtgaggccagtgtgtcacccaaggagagatattggggctgcttagtcaagtggatgtcagccagctgtgtcatgtgggacagctctgtactttctgcagacattagggctagtgctcagactgccctctatttatatcccttagtaattctgaggcatgggatacaattgctcctctaagaactcttgaggcaaataaagaggtagttaacatcaatggaccaactggggtaggaccttcaagtgttcaggcaaaactttgttaactgggctgctacccatgccatattggtgtgtcccaggaaggctgagggaagacagcaaagatataac

SEQ ID NO: 32308 - DNA, 362 bp, Homo sapiens
gctggggcttctcccaccccaacatgcaacagagaggggacgcttgctcattgtctagctagtcaatgtttgtttacagggagattgagggacagtgatgatacatcatgttaggcctgtctggacccagtgagaactttcatagtacagaagatccagaaacacatggtgacatgtgaaggtcacttcaacctttaggtccatccagctcagctctgcaatcatatgattttattgagattgaggaagagttgctaaaattccaaaaagaggattgcttgaacccagaagactgaggctgcagtgagccaagatcgtgccactgcacactagcctaggtgacaaaagtgagaccctgacta

SEQ ID NO: 32309 - DNA, 409 bp, Homo sapiens
gctgtggcttgatctcggctcactgtactctccgcctcctgggttcacaaaattctcatacctcagcctcccgagtagctgggactacaggcacggcttactcagggcactcaaatagatcttcctttcctttccctttccctctttccctttccctttccttttccttttcccttcccctcctttcctttccttttttttttttttttttaaaaaagatactgtcaccgaggctggagtgcagtggcatgaatatgactcattgcaacctccacttccctcatttaagtgattctcctgcctcagcctcctgtgccttagctgggattatgggcatgtgtcaccatgcccagctaatttttgtatttttggtagagatgaagtttcaccatgttgccaggctggactt

SEQ ID NO: 32310 - DNA, 544 bp, Homo sapiens
cttttctatgtgttactttttatattttgaagcccctgtccttggttggttttatctcacggatctgccatctaatttctttttaaatctcttcactttaatctatttctttgatatttgctctgtattactttccttccatttttctttcagaccgctgatttgatgctttgcagtaactctttttcaccttcattgagtgtttacctttgcgcactttgtttttctttggtttctagtaaatccagcaagtaagggctctaattgtacttccttgggcatttatttaaaaaaaaaaaaatgaaagtactttatgtctttcagtagtgttgcctcaggaaagaaaccatacttgttctgattattcacaagggctttcttttagcttcctcacctcttttaaatcagttctaagttttttagggggacgagcagagctattggagttgcttggaaaatggcaatcatttagatggtaacagataccatagttgacagtgtactatgtcattagcaagcaaactggtaaaatctgggggaacat

SEQ ID NO: 32311 - DNA, 523 bp, Homo sapiens
aatgaggattgcactttcacaatgaaatgagggaggacaggggccgatctctcagatatttgactgataaaccagtaccttttctagtatatgcgaccataggggaaattctctctaggctagataaacggaggagtttatttagtgttttagcaagctttatcgcctccataggtacaaattatttgcattttctagagcaagggataagacgcgccctggaatctttcctttttgatgtggattttccaattaggaaaggctgcccgtgaatagtcttttctgcttgagtgatggccaacacactggcaggtttgcaagctttctcttcatgagggtccgtccacagagctaggtgacaaacgctcagtccaggatctctgcaggttcctacacgggagccggagagcctgcgcgtcggagcctctttgttgctggggcgctggggtccagctgcgcgtgcgcagtaggccggcaccgacaagtgcgctgcaccagtggcaccggctgggggcgagccgac

SEQ ID NO: 32312 - DNA, 329 bp, Homo sapiens
gttactttccttataggactaaaacagagaggacttccttactacactgactgaggttgactgaaatctcctgttttttggaaaactggtccatttcaaagttcagtttgattatatgtcacttagcacaagcgacttcattctggtttggtctgattttctggggcctagagcaggaggctagtccataacaatggcctctcataaactttgtttaacaaaacctttcagaaatgagggtgggccggcacagtgggaggcccaggcggaggactgcttaaggtcagagttcaagacaagcctggccaacacagtgagaccttgtctct

SEQ ID NO: 32313 - DNA, 387 bp, Homo sapiens
tctgcctccaaagaaaaaaagaagtaaaaactaaaaggcagaaatgaaacccacaggcagacatcccggcgtcaaaccctgggcctagttgttaaagacagacccctgaactaattggttatgctatctatagattacagacattgtatggaaaaggactgtgaaaaaccatgtactgttctgttccattctaattaccggtgcaggtgcatgcagccactagtcatgtaccccctgcttgatcaatcgatcgcaaccctctcacactgacccccttagagttgtaagcccttaaaagggacagaaattgctcgctcagggagctctgtttttggagatgtgagtctgcctatgctcccagctgaataaagccctttccttctacaa

SEQ ID NO: 32314 - DNA, 496 bp, Homo sapiens
aggtatatccaggaaagttggctggagaaccatggtcagtatccgtccttggagtttgtggctctgttgtatgccttgcatacctgtgaccaggtatccttgtttggttttggggaagacaattgcaaaaggtggtcccattactgggatgacaaatattggtttgagaacaccatgcaaaatttcccagcagaataccagatcatcttgaaactgcagtgtgagaggaagattgctgtctacggctgagatgtttccagtggagtccccaggaggcttgacaggtagccaaggggaccttgtggtgtcagagagggactagggcttcaagcagaccctggatggagattactctgctactgaataaaaccctagcttatttctctctctggatttctggtggcattaaagggctacattctattactgattctgtcttatcaccatgtgactctcttatgctgtatcttaccaaaaaataaaattaaatgagaaa

SEQ ID NO: 32315 - DNA, 509 bp, Homo sapiens
tgggctctggggtcactatgagtatttagagtctgtcttccttgaagaaggtgaactccattctcctcccagctccaagaggaagcctggcacactagtggttgagtgagtggtgctgaaggcatgataggtgttccatgggggcagggcaggatccagcccgttacaccaccaccatcttttgtcttatccaatctctcaggtatccttgtttggttttggggaagacaattgcaaaaggtggtcccattactgggatgacaaatattggtttgagaacaccatgcaaaatttcccagcagaataccagatcatcttgaaactgcagtgtgagaggaagattgctgtctacggctgagatgtttccagtggagtccccaggaggcttgacaggtagccaaggggaccttgtggtgtcagagagggactagggcttcaagcagaccctggatggagattactctgctactgaataaaaccctagcttatttctctctctggatttctgg

SEQ ID NO: 32316 - DNA, 508 bp, Homo sapiens
ctatgtagtatgccatggtatatatgtagcacatttcctatatgtttttaagaatgattggaaccccagtcattcttaaatgagagttcttgtttgtgtgggtaatagtcatcaatattgaccatattagaaattaaaatagtattaaaatatttctatagttaattagcaataaaaacccattacatttttgcaaatatcttaatgtctggcttgataaaagataggctctcgaatctcgcgttcattcctgtgatatcacaggccttgcagcccacggaggcctctgctgtgcactctgtgagaatgagagtgagcaaggctggtggcggcttaggacgctcgggaaggtagttctgtgggactcctgaaaggcctcaggacccaggatcccagatgcacacgggagagtatgtatctggacagcgttatcttaatgcctctgcagaatcgtcctctggtattttggcatcagcatgctttttgattgcctgtctcaaaaaaaaaa

SEQ ID NO: 32317 - DNA, 649 bp, Homo sapiens
gcataatcctgtaacttttgcaatctatgatacatgtaagactctcagcttaaaaaaaatcaacatggaaatctccaactatttagaactaataaagtatgagtgcactgagagattcagccaaagtaacattgaaaggaaaatttatagccttagctatgtgcactacaaaattgaaaaagggctgggcatggtggctcatgcctgtaatcccagcactttgagaggctgaagcgggcagatcacaaggtcaggagatcgagaccctcctggctaacacagtgaaatcccgtctctactaaaactacaaaaaaattagccaggcatggtggcgggcacctgtagtcccagctactcgggaggctgaggccggagaatggcatgaacccaggaggcagagcttgcagtgagctgagattgggctactgcactccagcctgggtgacagagcaagacaccgtctcaaaaaaaaaaaaaaggaaagtgaaaaagaacaaataacgttttatttcaagaaactagtgggggaaactcaagtaggttaagattttaagagataaaaaagatttttgataatgacattagaagtaaatgttaaacgtcttctaaagagggttgatgatggcctacatgtctatggaacacagtt

SEQ ID NO: 32318 - DNA, 480 bp, Homo sapiens
gaaagtaaccagcaatggatatgtacaggggttcaaagaacctacttttcttatagacttctaaccagtattcatgtatttagtcatacatataaccctacattcagagacatctggtacctctattttctgagactgttgaggttcggttgcaaaacgcagcttgcttctaatttgtttcctgtctcaacttaaattttaacttccttcactgttgacactcatctatctgctttgtagcttgcaaaattattattaatataaaattagtattgtctcatctaccaaatctgttgtccctataggtataaatcttcttactcatttcttccaatttagtagtgtcaggaaaaaaaagagaatgcatttgattaactaaaaccttccaaattcacattacaaagggtactctagaaggtattatgtatttatttcctaatgcttacacctcttttgctacacaaagatagtacacatact

SEQ ID NO: 32319 - DNA, 425 bp, Homo sapiens
gccatgaaaatccaggcaagactgtggaagttccagagtggagaagcatagtggaatggggtcctttttgcttgagcccaggaggtggaggctgcagtgagccaggatcgtgcccctgcactccagcctgtgagacagagtgagactctgtctcaaaaacaaaaacaagacaaaaaaccctggcttttggattcagcaagacctgagatggattcctggttctgccacttaatttaaccctgagaaatgtaatctctgttactttatctatgaaacggagacaacaaatatagctatctcacagggacgttttaaatcgcaaataacatgttatgcttggcacagtggaggggaagtacaaagggctcaataaatgtttggccttgaggtgtaaagtgtttatgtctgtagcagtctaagactaa

SEQ ID NO: 32320 - DNA, 323 bp, Homo sapiens
aaacattatcctaggtgtttttgtgagggtatggtttatactaatatttaaatcagtagtctttgagtaaagccgatttcccaccatactgtgggtgagccttgtctaatcagttgaaggccttgctagagaaaagattgtcctctgttaggaaaagggaattctgccagcagaactctacctttggacttgaatggcaagtcttccctgggcctccagcctgccagccttccctgaagattttggacttgccaagtctccataatcatttgagctaattccttaaaataaatattaatctctcttcccccagggaacacaca

SEQ ID NO: 32321 - DNA, 207 bp, Homo sapiens
ataagcccaggtacacaagcactttccaagtctgttacattcacatttgctaatgccctctctattgaccaaagcaattcacttgattaggcccagagccagtgtacaaggaaacaccaggggcatggaaggtacagaggagagggcgggatgatcacagctgtttttgcaaacaatctttgacataaacagtgatatcaatgccat

SEQ ID NO: 32322 - DNA, 403 bp, Homo sapiens
accttgtctcactccctaaaagctaccactgcatgattttagggttctgggaagacagtcgcttccaaaaagagaatctgtggcatctggttttgatgctaggaattctttctttgttatgagataaatgtgtcaactacccctgaactatgtcacctttaagttctataatgtctattttaaatatttttgccagaactgtttccatctgagggaggagggaaaaggataaaggcatgttgagctctaggagctgggagcccacagaaaggaaaacagagcagggagatccaaggtccccagagacatggtgttcttcccatgttgggtgaccatcagtgtaccccaaaggttccaaaccccgaaggcactgatagacctggggggatgaggaggtatgaac

SEQ ID NO: 32323 - DNA, 488 bp, Homo sapiens
ttagtgttgattgtggtttggaggaaaggggtgttgtcatgtattagtggaagagcacactgttcaaattttggagcagcataaattggcagtactataaaaattaaaaatctacacacccaacaatctagtaattccacttaattggtatacagaaatacttgcacaaattcacaataatttatgtaccaggatatttatcagcagttttatttataataatggaaaactgagggcaatctaactataagtcaatacataatccatactctgaaatacaagtcattaaagttattaagtaatgtctgaagatattaacatagaaggatgagctcaatatattaatgaatgcaaaaaaatgtagaatggtatacagtacatatagcatagtaagctcaactaatggattcatggtacttgtttccattattttattgttgtagtaggagcagaaaagtagtaaaagtattttaacccaaagaaaaaaa

SEQ ID NO: 32324 - DNA, 400 bp, Homo sapiens
gtgacaatggaaatgtttggattctgtgctatccaatatggtagccatgagccacatttgaacacttgaaatacgggtagtgcgaagaactaagtttaacttttattccattttaactaaatttaaatagccacatgtggctagcaggtaccatattggaccacatagctataaaccatttgtgcatggggagagaatgactagcatctcctcccagccagagccccagctagcgtggttctatgctgttggggtaaacatgatcttgcattttctagttaccttctccccatcccactctccatactagcaggtattctgggtcagaccgatttggtctgaagctacttagacttaaaaaaaggagtattctatgtactcccatccagcttagagctct

SEQ ID NO: 32325 - DNA, 245 bp, Homo sapiens
ttgcccagtttggtaagggctgcgaaggcctctgctttacggggtctcaataagacatatgaccccagggccagaggcttatcagaaccaagtcaggtcaggcacagtggctcacacctataatctcagcagtttgggaaaatgaagcaggaggatcacttcaggccaggagttagaggttgcagtgagctgtgatcgcaccactgcactccagtctgcatgggcagagcaagatcctgtctcaa

SEQ ID NO: 32326 - DNA, 205 bp, Homo sapiens
cttggatgttcaaggaagaggtgagagtaggggattcaaagacaagcatggcaggtgatggtggcaaacagacaccaaaagaaagatcatagagggccttgagggccaaggtaaggtctttggaggtttgtctgaatttgatgggagcattctgcaaggtttggaggtttggagcaaataggtgatagaatccaacttacaaatt

SEQ ID NO: 32327 - DNA, 205 bp, Homo sapiens
aaaactgaattatagtctgttgtatggatttccactgattattcactgcttccctgctggtggatatttcctttaaaagtacttgtgtagaaaagtgtgtaacttttgacataacatttaaatgtattttgatattgccaaattgctctccaaaaaaattagttcctaccaatggtaagaaagaggaggaggatcttttgatgtt

SEQ ID NO: 32328 - DNA, 575 bp, Homo sapiens
agagggacagggactttgtctattcattattatatttctatgacttgaaaggacctacatgtcataggaggaactctaaatatttgttgaataaattactaaatgaaagaaaataggttaagaagtgacttaattcctcccctcaatgttatttcctttctcagaagtagctacagtctggaatctctttctccagaccctcttctgttcacttacatatatattatatattgtacataatcacatattcattttttctacataaatggaatcatattatgtatacttgtctgaaatacacttttttctctttcatatattttagagagccatccaagttggtgcatatagatcctcaactcattctttttaactgctatatagcattccatattgtgaccatttcataatttattgaatgattctctattgattgatactttggtggtttcttattttttgctaattaaatgtttctgtaatgaacatccttattcatatatccttgtacatatgtgagcatttctgtagcacagatttagggttctttctatagatataatatgtataaagag

SEQ ID NO: 32329 - DNA, 454 bp, Homo sapiens
tggtcgcgaactgttgagctcaagccatctgtctgccttggccacccaaagtgctaagattacaggtgtgctacggtgatttttatttttattttttttaaattgttttttgagacagaatctcactctgtcactctggctggaatgcagtggtgcgatctcggcatactgtaacctccacctcctaggttcaagcgattctcctgcctcatcctcctgagtagctgggattgcaagtgtgtaccaccatgcctggctaatttttgtatttttagtagagacagagtttcaccgtattgacgatgctggtctcaaactcctgacctcaggtgacctgcctgcgttggcctcccaaagtgctgggattacaggcgtgagccacctcgcccagcccagttattttaatgactccatttaaatggatataaaaataaactatttttgtgctttctga

SEQ ID NO: 32330 - DNA, 743 bp, Homo sapiens
gtgtgtataagtgtatgtgtgtatatactgcgctccagcctcagcgacagagtgagactgtatctcaagaaaaaaggttttgaaaaaggaaaaggaggtgttgcttcagccacatcttaaaggaggtaacacttgaccagaaggaaaagggatctggatgttcttggtacagaaaccacaagttcatatgaacagaagtgtcaacagctgaaaaagtaaggggacaagtagtcccatgggactgcagccaaatgtacaaggttagcgaccagataagactctggacgggtcagcaggaggggccaggtgatggatgccagaccactgggtcctgggtacttaccacattgtgcttcctagtccccaagatgtggtcctcaaaaaaacgaaaagtcacggtcaaatgaatttgggagatgccaagttaaagctctcccaagcagggaaatatagaggaccaaaccccttttgtaggaaaaccctagaaaacctcacttggggaattctgctataagcagtgaaacaccatggaaggattctgagctgttgacaacagattttcatttagaaattcattctgcaaaatacaaaaattagccaggcaaggtggtacatgcctgtagtcccagctacttgggaggctgaagtcaggggatcacttgagcctgggaggtcaaggctacagtgagccatgtttgtgtcactgcactccagcctgggtgacaaagtgagaccctgtctca

SEQ ID NO: 32331 - DNA, 144 bp, Homo sapiens
tacctatacatacttcccaaccctaacctcatatgtccattaaaatattgggcatcatggtcctgtaacctctccccattgccagtatcaattaagattcctcttcttctcacagcaaataaaatcccatttgtatgatttaag

SEQ ID NO: 32332 - DNA, 435 bp, Homo sapiens
gaagtgcaggtatgatttaatcaaaagagctaaattgctcatttatcacccaccctgaggtcatttaggtaatgcagacaaaggtgttctctcataattaatgtgctctccctgtgtgtttctgtggcttaaatgtaatagtccccgtcattggagcttgtttaaaattgctgagatgttcaagtgggtgttgggacgccatgccataatgcagtgaaagtcatatgttaaccaggcctcacactgctgaaagggtcttggccctgggtggagtgaggaggagctggcatgtgtataatgaccgtggttctgcttccagaacatctggacttcctgaactttgctggaaatgttgctggaaattcaagccttaaaaggtgctttctgcctgccccccaaattatcagcctattccaggagagcgtatgggaggat

SEQ ID NO: 32333 - DNA, 4838 bp, Homo sapiens
  misc_feature (686)..(686): n is a, c, g, or t
  misc_feature (4263)..(4264): n is a, c, g, or t
gtctggagctcttagagacaagataaacagcgatgtctggttctgctcagaggaggctttcttaagtgagaggcacagttggatcagcagactcagctgagtgtgacctgctctgttccctccctgctgacctgggacagtcgctaccaggcagtgctggcctctgggcgggtgccgaggagggtcatccctgagcactcaccaggtgagatgtctagggtcagagaggcagcgactggtccagagacccagatgtgaccctgggccatgctcttagccctgccctgtgctacgctggactcaagccctgacctctgtggcctccctgccctggattccaaatccatccggggttccagcccctgatggggcagagtctggccctggaagagccactgggacagagatcctatgggtgaggtggagggggtggtcctcagtccaagtctgtgccctaagctgggaccccgcgggaggtctcaccaactcagacttcacatgtggtcactgagggtcattgtgggacccactggacacagggggtcccttgtctgggagtggggtgaagagccttctgcccttgggcagttaggtaggggactttgagcactgctgctttgggacctgggaagtggggacctgggcagcggggtcctcgtcattgagaacatggtcagtgagagatntggtcatcatgggttgggtcaggggggcctggtcagcagagacttggacactggggcttagtgaaaatatgatcagtggggaaatagtcacggggcctgctcagtagggcctggctagcagaggcctggccagctggccactggatgacctgacagggggtttgtccttggagcctctttgcctctattcatagtggggatgagtcatagcatccctcagcactcgccaggtgcaggttttgtgctgaccttgtagatggccttttccttcatccccacagcaactccatggggcggatcctgtccccgaatgtagccattccacaggtgagatgtctagagtcagagaggtgatgactggcccagagacccagatgtggcctgggccgtgcactcagccctgccctgtgcagtgctagactcaagccctgacctttgcagcctccctgccttagatcccacatttccctggggttctggaccctgatggggtggagggggtgattctcagtccaagtctgtgcccaaagcttggtccccacaggaggaggtctcatcaactcagacttcaggtgcggtcactgatggttgctgtgggacccactggacacatggagtccttcgtctgggagtggggtggggaggcctctgccctcgggcagttgtggaaaatgaaggagctctagagggctgcctggagggtgatgatcgtccctcttggtcaaaggggcttggggactggaaccttctctgtctgattctctagaggtcttgtcttccctttgtcccaagtattcccaaggaagatggtccccctgggtgttctccaggaccaagtccccagaattctcttgttttttccttggtgatccaggaaaacgaagccccctcctgtattgacagctgggaattgtggagtccaccgtcctccacctgagacgagcacagggtctccacgaggacagaggctgctttggactcaatagaaaactgggcatcttcatggtcctagaaggatcccaggaggctgatcctatagagacgtctggttcctgaccccaactgcctccaggtgcctggaacagcccatcgtgggccctttaccctcagcaggtggacgccgttggtcctgccagggatggagatggatgagcacccggatatcctgcccacccaggggcaaggcaacatcatcattactaagtatgagcagggacgctgagctggggcagcagtggacacagagcatgagcgtgttgacatctggaaattcaccagtcgtctctgggttgtgtgtgagacagagctgcccgtgtcagtgccctggaggtgaagggaagagcctgtgcctgctgcgtgggagactggtccagggacagggaatcaggagtggttgggccccaaagcccaggacccagcatccatgggccgctgccggaggcctggcagctccgctaactccatcatggctcatttgacagcaaaggtgtcaggaaataaaatgtactgacaagtggctgaagatgcttggagactggccaaaatataagaacagcaagaaggtgacatggcggttgggcctggtagctcaggcctgtaaccccagcacttcgggaggctgaggtgggcggatcacctgaggtcaggagttcgagaccatcctggccaacatggcgaaaccccgtctctactaaacatgcaaaaattagctgggcacggtggcgggcacctgtaatcccagctactcaggaggctgaggcacgagaattgcttgaacccaggcagtggaggttgcagtgagccaagatcgcaccactgaactccagcctgggcgacaagagggagacttcatctcaaaaggaaaagaagctgtctcgaagcaggtacaaaggcattcccctggtgtgaggccaggcgtgggcacttctgctagacattgacaaagtcaagtcccagaacccaggaaatacaaggaggtgggctaccacagggacctgagccgcaacactgccgtcctcctttatctgccggaggaagatgctttctgggtggctggctcagctgctggccggtgagaggcactccctgcaggcccaaatactgcccagctccggaagctcctatcacatcaggagcaggtgctgcacaagtccttcccaaagatcatgagacagctgggcaaggaagggctatgcattgagggttccatgctgacgaggctcctccagtgtttccttgatgggccacctcactgctgagatgagtcccccatgaggagctgcaggaccttgtctgaccgcagcctcatggaggggtctcatcccatggaaaggggtcctcagcactccagaggactgaaaccccaatgggtcctgctcaggccaccagccccagcctggaaaggccaggtcctcccacacctgctgtccccaaagaaatccttcgggctcaccctgcgactgtgggatgtgcttatcttggagggcgagcaggtactgacagccatggcgcatgcatcattcaaaatacacagggagcacctcatgaagctttcctggagcaccgtctgggagtttcaggagcgactctctcagagctgggccctggaggacaactcggtcctcaggaaccttcaaacctctatgaaggaactcacaaaaaaacactgggacctgccatccccaggagaactcgagagagggtcctcgagggtgtctcctggcattaggcccctctgtgagggggacagattggccctgcccagcccaccagctcagctccaggggctcatgccatcagccccccaggacaaaagccttgtcctcccccagcctggcctgacagggttgtctccatggcggaggccaaggcccagcagcacgaaggggcttccccagaacccagggcagcaggctgctctctgggtggcccagaggatcaagatgtggccaccctgtttcccggtgaggtcaggcctcgtattacataaaaatacctgtgctgggactctatgccacacctccacacagacctggatgctgggatccatggtttccttactacaattttgaacagggctactgggcccctgtcacttcaacatgttacctggacagccctgcaaccacacgacgggcctggcccagcaagcccactgggaccccgacaccaggccctgcccaggcttatgacagaggaggcaggtcaggagacaccccagcaacaaggcagcacctgcctgcgatgcccctcagtagaagaacgtggcatggaaggagcccaggtggcacacgcccagctgcgtcgcagccccagatggctgctggaccttggttctgggccttggaaaatcccattcagcggggcttggtcccatcaaggcctctggagggaaggctaagcatagggttcctgcagccccagccagccagccagccagcagcatgccctggggcctctgaccccacctgtgagtcccaggcccagaggtccctggcttcaactcgagtcctaggaagagagaggcaccagaggcaccacaggctcccagggtgaccacagaggggaccagggcacnntgagccctgatgctgtaaggattcacatcagagaacctgggcaagacgggagaccgtgcagtaatgaggatgtggagggctggctcaatgcggccaacagctgtgaacactgctgcctcttcccagcctcatcactgcagtgcaggcagtctgatctctggagcccagcccaaaagtgtcctgagtgccccggcttcacatgccaatatgccacctggaggcttcaaggccctgcctgctgcacgcccgcctcaccattgctgagcaccccatctgatgatgagagacttgctgtggattcctgggccggcaccatttcccaggaggaccagcgggctgcctgtgggcaggccgcccacactgtggagggggctgagatcagccttcactgtaggaagcccctacctggacacagacttgccggctctacctatcgccatcatggcagcctacatggcattacttgtgaccagggtgccccatccaggtcggtctgccctggctgctgttttccctcctgccaccctctctttgactgcttgtgtcaataaaaggagaactggccagttttcag

SEQ ID NO: 32334 - DNA, 557 bp, Homo sapiens
ccaggccagaaggagatttcttttctttctttatttttatttttatttttattttttgagatggagctttgctctgtcacccaggctggagtgcagtggcaccatctcagctcactgcaaacttctacctcccaggttcaagcgattctcctgcctcagcctcctgagtagctgggactacaggcatgcaccacaatgccaggctaatttttgtatttttaatagagacagggtgtcactgatacacacaggagacagggaaatactggatagaagagggcagttccctggcaaaggcccaccctcaagcctggaaacctgcggccctaaatgaggacaggcattcctgttttcgcccccaaaagttgccttttgacctgccatgctcccctatcctgtacccgtataaaccccaaaccccaggctccacaagcagatgagatgaacagaagagcagaatggcagaatggcctggcggagagaagaggagtgtgtgaacacggagaagagttcggctggggacagttggagaggagattggccactgaatggccaaa

SEQ ID NO: 32335 - DNA, 367 bp, Homo sapiens
cacatatagatttttctgcaggaagcaaagggctttcaggcttacttgatgagtagatttctgcatcacctccgtggtaaagggttagctgcttttaagaggcaaaaatgcccagactgaaataaagaaggaaaaaaaataataatacattccagaccaccttgtaaaaaataggtaggcgttctcaatcttggcctttcactccagtcccacttgaggtcactctctttccagaggctctatggaacaacaagggtggtgagaacgctgaattaggaggcaaaagcccatgctagtgttctgtcccctaatgtgacccacggttagtggggattcctgtttcagaaccttcaacctgctcttcctc

SEQ ID NO: 32336 - DNA, 231 bp, Homo sapiens
agatactgttattattctccttattttttttcttaccaacttctgtcattcctgttcggtaaagtgcccttgtgtgatttaatgtctggcagtggcctgtggaaacctttcgagtcaaactatcatcttttcttccttggcaatctcctattcttcaggttttaagcaatgactagtttttacattttcagcaccttatatatttaatagtggattaaaaatcctgatgtg

SEQ ID NO: 32337 - DNA, 444 bp, Homo sapiens
gggatttttagtacgttcatagaattgtgcatcatccatcaccacaggccactttagaacattttcatcatcttaaaaacaaaagacttgttggtggctccttcctgtagttccagctgcttgggaggctggaggtgggaggactgtttgagcccaggagttcaagtccagtctgggcaacatagtgagaccttgtcttgagcaagaggaagaggaaaggagaggaaaggataaaaggcagaagagaggagaggaagggagagagagagagaaagagaaagaaggaaggaaggaaacaaagaaagaaacaaggaaggaaggaaagaaagaaagaaacaaggaaggaaggaaagaaaaagagaaagataaaaagaaaaaaaggaaggaaggaagaaagagagagagaacacccactgactgtcattctaggcaaccactaatttg

SEQ ID NO: 32338 - DNA, 362 bp, Homo sapiens
gacagatgaaacccacgaatcttttgtttccctgcaaaccctataaaacagtacaaaaagaggcatatactcacaagatggagattacaagaatggaggcagtgacagtcatatttaattgtttggttaaaaaaatacataatttaggctaagtgtggtggctcacacctgtaatcccagcactttgggagtccaaagtggaaggattgcttgagcccaggagtttgagaccagcctggacaacatagtgagactccatttctctaaaaaaaaatttaaaaattagctgggtgtggtggcacatgcctgtggttcctattactctggtggagactaaagcaggaggatggctggagctcaga

SEQ ID NO: 32339 - DNA, 325 bp, Homo sapiens
aaggcagcagcttaggagcagcgtattacaaaggaaatatgaatagtagaaaatagacttcaatatgttaaatatgaagattataattattgaaaatgtatacttttagccctctatttctaagaaaatacctaaagaaacatgtactgttctaatgatacagaatttgttcagaatttttaaatatcaaaacatttttgtaataaccttccagcatagcaacctttctgcagatagcgatcataaactcgggacggaattaaacaaaacagaacaaaacacatactgtaaaactctagaattaaacaatgataggcagattctg

SEQ ID NO: 32340 - DNA, 438 bp, Homo sapiens
ttttttttttttttttgagatgaagtcttgctctgtcgcccaggctggagtgcagcggtgcgatcccggctcactgcaacctccacctcctgggttcgagcgattctcctgcctcagcctcccgagtagctggaactacaggcgcacgccaccatgccaggctaatttttgtacttttagtagaaacggggtttcgccatgttggccaggatggtctcgatctcttgacctcgtgatctgcccgcctcagcctcccaaagtgctgggattacaggcgtgaaccaccacgcccgaccccactttcttccctctctttaccattccaggtaccaccactcaactcctcctcctagtactcccttctcaaaattttcccactgcttcctgataatgccggacttctaaagctagagaaaatcctctacagtctagtctatc

SEQ ID NO: 32341 - DNA, 464 bp, Homo sapiens
accaggagggattgtgccctgttcttgctaactgggtgctcgtaactggagacggggtgtacctgttagcggtggttagacgaggtggatacagaatccagaatggtcacattgcagccatagggaacagatagatgcagagaagaggcttcagccctctgagttagggcagtgcatggccttgctctgctgaaatagcccagaggtcccatttgcttggtgacatctctcacttgaatagaaagctggctgtttatcagacactgttttcttaaatggcagctcctccacatctgcgtcatctccattatctcccctatccatctctttttggaaggaatccacgaagccctcatgactgtttgtttgtttttgtttttttgttgtcgttgttgttttttggagataggttcgtcctctgcattccagccggagtgatagagccagaccttatatcaaaaaaa

SEQ ID NO: 32342 - DNA, 469 bp, Homo sapiens
tttttttgagatggagtctcattctgtcccccagcctgtagtgcagtagcacaatcttggttaactgcaactctgtccataggcatcagttttaggccaaaacatatggtaatacataaactgatcatatgctgtctgcatcactcagcagagaaaggcagcatctcaaaggatttcctcaaatcctttatctaagaaaggcatggaaaccatttcaccagaaatcatttcctccatggtagtgtgcaaagatagtccactcaggtgcataataaaccctcaggaaataatgaaaacagcggactctgttgcaggtggagatgaaaatagtggttggtcttaaccatctatgcaatgcaatcattaagatatttaaatataagaaacccatttcatgggtctctaaaattatgcttctatttcaacaatccagggtagaaattgtgaaaagcggtctctctgtgggtgc

SEQ ID NO: 32343 - DNA, 292 bp, Homo sapiens
agtcccaagacactgagatccgggtattcttcctgaggctgtttcctcttcctgtcttcagggagtggaggcctcaggatgaagctaagctccttggagagttctagtcagtgacctttgattctgtgcctggggctgggaaatgcttaggggactgtcacaaacccatatggttcctttgtgcggagttggaaaatgttccatcagtttgaaattgttgggctaggcactgtggcccatacctataatcagggactttgggaggctgaggtgggaggattgcttgagtcca

SEQ ID NO: 32344 - DNA, 758 bp, Homo sapiens
aacgtgagctcactttaggaaggatacgaacttggcattaaatatgacggaagcacctactgagaaagcaactccctcttcacttccccttcgaacaggcttagtttgatactgagatgtctttagcatctctcatatttcttgattctctttttaacaaggactgagctttgcaaccatatgcaaccaattgagctttgcaatccagactcatgcttgcaaccatatgtcaggtatacttaggtggacacctataaaattgttgtaactcaaaaatggctgagtaatggcacttgtgcgtggctctgctaataaggcactgatctctaggaaacgtcagcgtgcagatgtggcctttttttcctcacccaattctactaactgtcttgtttctatacctccctccttcctacctccttacccagcttaatttccatggagtactgttgctaatacaacccagtctcccaggcccttcctgttttcctagcatgtccatttggcaaaacctcaccttggatgaaccccagctttccgcttttgatttacctgcacctgagcctcagtgcttaactggagaatgttacacaagaacacaaactcctctcatcacacacgcaaatctgggtcactaacctcagaagcagatattctcttctgccggatcgtcttcccaatatgtttttcttttattaatactttttgtccccagagacctgtgttctttttttattctacttttttgagacagagtcttt

SEQ ID NO: 32345 - DNA, 353 bp, Homo sapiens
cctcttttccccgtatttctggaataaggtagaaaaccctcctagttcctggaaattggcaattgacagtgttagtggttcctggagtagccccttcctgtggatcctactcctgtttttggctggatgggttcaactccattaggaagagagcagggtatgtgaggtggcctcactgacatcagcaataggaagaagacaaaaggaggagataggtaaatcataagcaacacaagaatcctgcaacgtgaggacattgaatgtagaggaaaatgactcagttggtgctatgcaaatgagaaccaaggttatttaatgacaaccaatgctcattgggatgatcctggtccact

SEQ ID NO: 32346 - DNA, 356 bp, Homo sapiens
tttttttttgtgagacagagttttactcttgtcattcaggctagagtgcagtggcgcaatctcggctcactgcaacctccacctcctgggttcaagccattctcctgcttcagcctcccaagtagctgggattacaggcgtgagccaccacgcctggctgatttttgtatttttggtagagatagaatgtcaccatgttggcaggctggtctcgaactcccgacctcaggtgatccgcctacctcagcctcccaaaatgccggggttacaggcgtgagccaccatgcccaaccttttgtcatttgtagccattcctaattcttgtatttcagttatctgttgtaaatgttgtctgc

SEQ ID NO: 32347 - DNA, 178 bp, Homo sapiens
ttttttccttttgtcatttcgagaagacaatgagtatacctgcatttaaaattgggaagggaacaaaatttcattttcaaaactagcatcctggatttcttcttccttatttcttttcgacatgttatactggggatgaggcgaggaaactctttccagagagaagtcattccatact

SEQ ID NO: 32348 - DNA, 795 bp, Homo sapiens
cacacaacatggccttcagcaatgctgattcaggctttgtggatgcccagctggtgctgacccacaaggacctcctgtctggcagtatcatggccacggatgagcccatgcagcccatcttctgcttcatccaggaggggcctcaggaagaggcgagtcctgttcacgcactcaggctgaccatggctggatcctgctgcatgtgtccgacaggcagcaccaggccatcttggtgctggaggtgcaggccttggagccttacctctatgtggccaatggctccggcctcaaggtccctcaaggagaccagggtaccatcaatatggccgagctccacctgggcaccaacctcgacatccgcagtggggatgaggtccactaccacatcacagacagcccttgctggggacagttgctccaggccactcagccagcacagccttcgcccagaaggacctgctggttggggccgttctctttggccacaatggcagcctcagctcccgcaacaccctggccttctcaatggatgtggggccttctcaatggatgtggggccttctcaatggatgtggggccagtgcacacagacagtgcacacggtgcactctacaagtgaccattgccctagagggcccactagccccactgaagctggcctggcacaagaagatctacatcttcctgggagaggcagctgagatcagaagggaccagctggagaccacggagttcatcatctcggagccgctggccaatctgtactcatgtggggaccagaacacactgatggag

SEQ ID NO: 32349 - DNA, 451 bp, Homo sapiens
ccacctcattccctgacagcacaacctcgttgatcttccggtacaacctcatttcttctcccaacacagcttcattctccaacagctcaacctcatctaatcttatgcctccagccagggcctgccagatctccgggagccaaaggagagtgtagagaaaagagaggtccctcatttgctgtcccccacccacaagggctgcctggtgctataaccatccaatttctccaggcccagaaggggccatggactttgagttctaggctgcttggccaagccagaactccactattgccctgcctcctgttctgtccccaccatggctacagagggcccacaggatggattctgggacatggactcatggttgctgtaccatcttcttatttatttatagccaggttcgttcattctttcttttcttttcttttcctctttctttctttctttc

SEQ ID NO: 32350 - DNA, 650 bp, Homo sapiens
ccacctcattccctgacagcacaacctcgttgatcttccggtacaacctcatttcttctcccaacacagcttcattctccaacagctcaacctcatctaatcttatgcctccagccagggcctgccagatctccgggagccaaaggagagtgtagagaaaagagaggtccctcatttgctgtcccccacccacaagggctgcctggtgctataaccatccaatttctccaggcccagaaggggccatggactttgagttctaggctgcttggccaagccagaactccactattgccctgcctcctgttctgtccccaccatggctacagagggcccacaggatggattctgggacatggactcatggttgctgtaccatcttcttatttatttatagccagagaggaggatttcttatgttgcccacgttggtttcaaactcctgacctcaagtgatcttcctgcctcggcctcccaaagtgctgggattacaggtgtgagccaacttgcctggccatctctgtgccatcttcttctgatcctgggcagtgggactaggggaagttaccttttctggggcacatttagtggtgtgctggcaaatgtttaaccaccagctcttctggaagttaaaaaaaaaacctacctga

SEQ ID NO: 32351 - DNA, 3182 bp, Homo sapiens
ggggccggctgttggcggcggttggctcggcgcgggagtcggctgcacgtgcgggcgggggcgatgcgtcactgatcggaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtatgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctgcagggacctgagctttgctacccaaccagattcctcatagagattcctaatcactagtttcttgtattcataaactcagagatacagagggcttggtttgaagttggggtgagatgaaacctttgctctgagccaaagctctggggccttgcattccctgcattgggttgatgactgtcagcatcactgccgcaggccatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgccccatcacctctgtctaaaggcccaagtcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcaaaaaaaaaaa

SEQ ID NO: 32352 - DNA, 3240 bp, Homo sapiens
ggggccggctgttggcggcggttggctcggcgcgggagtcggctgcacgtgcgggcgggggcgatgcgtcactgatcggtgaggcgcggccgaggggtcggctttcctcgcgagcctgcggctgggcttcttctcagaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtatgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctgcagggacctgagctttgctacccaaccagattcctcatagagattcctaatcactagtttcttgtattcataaactcagagatacagagggcttggtttgaagttggggtgagatgaaacctttgctctgagccaaagctctggggccttgcattccctgcattgggttgatgactgtcagcatcactgccgcaggccatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgccccatcacctctgtctaaaggcccaagtcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcaaaaaaaaaaa

SEQ ID NO: 32353 - DNA, 3128 bp, Homo sapiens
ggggccggctgttggcggcggttggctcggcgcgggagtcggctgcacgtgcgggcgggggcgatgcgtcactgatcggaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtatgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctgcagggacctgagctttgctacccaaccagattcctcatagagattcctaatcactagtttcttgtattcataaactcagagatacagagggcttggtttgaagttggggtgagatgaaacctttgctctgagccaaagctctggggccttgcattccctgcattgggttgatgactgtcagcatcactgccgcaggccatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaatcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcaaaaaaaaaaa

SEQ ID NO: 32354 - DNA, 1980 bp, Homo sapiens
ggggccggctgttggcggcggttggctcggcgcgggagtcggctgcacgtgcgggcgggggcgatgcgtcactgatcggaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtatgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctggaagcccatctcggggctgctgtgtggacggcgctgcctcaggcactctcctgtctgaacctgccttatgtgtttaacctggtgctcaggatgcttctgataggggggggggggaggggtgggctgtgaaaattgcgtttcaccacatgggctgctcgggggccgatgtagggggcagggggcgagggggagggccgggggggcccgggggggggggggcccgggccggggcgacagcggggggggg

SEQ ID NO: 32355 - DNA, 1203 bp, Homo sapiens
  misc_feature (896)..(897): n is a, c, g, or t
ggggccggctgttggcggcggttggctcggcgcgggagtcggctgcacgtgcgggcgggggcgatgcgtcactgatcggtgaggcgcggccgaggggtcggctttcctcgcgagcctgcggctgggcttcttctcagaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgnntgcattcctggcccgaaaacaggaaagcggatgcggcaatcatggggacacaaaagccaccgccaaaaagccgaggtggaccccggacaatggggggcgcaaaagtccacgccgcgggtcaaacgggtaaccattggggaccgcaccccgcaggtcagggaccccacggtcgtggtgaatacgaaatctgaccgcagcgaaaagcgcccgccctgaggcagagcaggcgacactcatccacaaaacagtcgcgaccagcagatcgcccaaacacacggggcacgcggcaaaacagccatcgcagcg

SEQ ID NO: 32356 - DNA, 531 bp, Homo sapiens
gcggccgcagagcaagaggcccaggaaggaccctccgagcgctgtggggagcggcaacgccggtggctcggggccccgcggaaaaggtagggcggcccgtccccttgggagaccccagcccctctccggggtgtgccgcgggggagaggaacccctcgccccagccgggctccaccctagctcacccatcccgcggcctacactgaggctctcaatttgggtggcacttatggggcatgtgtcccctctctccttcgaagaggctgcgactttctatatttaaactctttgaagaggcagtgagtatccttttttgggggggagtcgaagagatcccttaaagctgtttcctttccaaaggatcactgatggttttctatggttttgtgtttcaaacagcggacaatagttcggaaacgggaagagaaaaaaatacctgctgtatctctttcccagacatcaggcggtggaaatgcaccaagggagcaggcttttgaaactcattggggggaagatgggtaagaagcggag

SEQ ID NO: 32357 - DNA, 769 bp, Homo sapiens
gcggccgcagagcaagaggcccaggaaggaccctccgagcgctgtggggagcggcaacgccggtggctcggggccccgcggaaaaggagctgaaggtggtggatcatcgtctggaaatgtgtctggggttgcccctgctgcccctgcagggggctcgcgctcctcctcccggaacttagggtcttctggtggcgagaaggaagaaggcaaaaaggtccggcggcagtgggagtcgtggagcacagaggacaagaacaccttcttcgaggggctgtacgagcatgggaaagactttgaagcgattcagaacaacattgcgctgaagtacaagaagaaaggcaagccagcaagcatggtgaagaacaaggagcaggtccgccacttctactaccgcacctggcacaagatcaccaagtacatcgactttgatcatgtgttctctcgaggcctgaagaagtcatcccaggaactgtatggcctgatctgctatggcgagctgcgcaagaagattgggggctgtatggatgacaagaatgcaacaaagctgaatgaactcattcaggttggggccaccactgtacgttacaaagggcggaacctgcggatcaaagcgcccatgtgccgggccctgaagaagctgtgcgatccagatggcttgagtgatgaagaggaccagaagccagtgcgcctgcctctgaaagtccctatagagctacagccgcggaacaaccacgcctgggcccgtgtgcagagccttgcccagaaccca

SEQ ID NO: 32358 - DNA, 1042 bp, Homo sapiens
gcggccgcagagcaagaggcccaggaaggaccctccgagcgctgtggggagcggcaacgccggtggctcggggccccgcggaaaaggagctgaaggtggtggatcatcgtctggaaatgtgtctggggttgcccctgctgcccctgcagggggctcgcgctcctcctcccggaacttagggtcttctggtggcgagaaggaagaaggcaaaaaggtccggcggcagtgggagtcgtggagcacagaggacaagaacaccttcttcgaggggctgtacgagcatgggaaagactttgaagcgattcagaacaacattgcgctgaagtacaagaagaaaggcaagccagcaagcatggtgaagaacaaggagcaggtccgccacttctactaccgcacctggcacaagatcaccaagtacatcgactttgatcatgtgttctctcgaggcctgaagaagtcatcccaggaactgtatggcctgatctgctatggcgagctgcgcaagaagattgggggctgtgagtacgctgactgtggggttgcccacggctcctcctgtcctttgtcacctttgggctttagtgctcagagttgtttctagtttccctctaacttttatcttgaaaaaattttactagaagaggtgaagaatatgatggcggccgtgctctttagcttagatggacctgttgctgacgttggctacatttgctctctttctccatgcacatgcacacatgctcgcgtgcacacatgtgttcacacactctgcattccactcgactgtaagatgtcacgccacagcccagaatacctccaccggcatcacctcagagaacatttctcctatatagccttgataccatggtcgcacctagacttttagcatttaccaaacaggtgtagtgatcttacctaatttcctgcccatattcagattttctaaaacatcccaaaatatcagtcagggcttctgtcaagggccgttgccctgcatgtgactgtggagtctcccttgggtgtctttgacttagagcggccg

SEQ ID NO: 32359 - DNA, 813 bp, Homo sapiens
atgaaatgtgatgtgaggcttcattttgcagagggaagggatctctgtctccattgtggacagggcgtcttaggctgcagcgtcattgtgctgttacatggttccacataaaatcttgctccttttctaagagctgaaggtggtggatcatcgtctggaaatgtgtctggggttgcccctgctgcccctgcagggggctcgcgctcctcctcccggaacttagggtcttctggtggcgagaaggaagaaggcaaaaaggtccggcggcagtgggagtcgtggagcacagaggacaagaacaccttcttcgaggggctgtacgagcatgggaaagactttgaagcgattcagaacaacattgcgctgaagtacaagaagaaaggcaagccagcaagcatggtgaagaacaaggagcaggtccgccacttctactaccgcacctggcacaagatcaccaagtacatcgactttgatcatgtgttctctcgaggcctgaagaagtcatcccaggaactgtatggcctgatctgctatggcgagctgcgcaagaagattgggggctgtatggatgacaagaatgcaacaaagctgaatgaactcattcaggttggggccaccactgtacgttacaaagggcggaacctgcggatcaaagcgcccatgtgccgggccctgaagaagctgtgcgatccagatggcttgagtgatgaagaggaccagaagccagtgcgcctgcctctgaaagtccctatagagctacagccgcggaacaaccacgcctgggcccgtgtgcagagccttgcccagaaccca

SEQ ID NO: 32360 - DNA, 686 bp, Homo sapiens
tttgagggaggggctgcagctactgtagggcttttattccagaggaactttaatattcggtaatgggatttgagtctatattgagcggaattgtatgggaatcttcagtggctttgctcctaactacattgtggtctcatttatttattttttccatttaaaggtatggatgacaagaatgcaacaaagctgaatgaactcattcaggttgggtaagtcccagtttccatgtgaaacatcacttctctgggtgttttgtgtttattctctaaaatacagaagctgaaatgctctcagtgaggaccttccgagttaaaacttcataacctctcagttacgtgttcagtcccaacaaaaggtgcttggtccagggagcagtgactgcgcccagagcctgtgcctgccccggggagggaaggaagtgccgtctttggcctcctccttcccgagggtctctggctgggcgttgtggtctcgacgcagcactcagggccctgctttttgtgctccttttcctccacctttgtgcctgctgtggggctggtccccggcttctagggcctctcctttccattgcatttttgtcgtgtcctgggccacttctgacagcttccctgccttcttgtgccctggatgcttctgtctccaactggccgctctcctcccctcacacacctgactcccag

SEQ ID NO: 32361 - DNA, 334 bp, Homo sapiens
agtgtcccctgtggttgacagcttgcatgacaaaggtacagggaggagatccaagaaaccacgtgagcctggtgtggctctcacacccaagccaggcagcgcctcctgttcccctctctaaagccgccttctcttctgtttctcagtgttctctcgaggcctgaagaagtcatcccaggaactgtatggcctgatctgctatggcgagctgcgcaagaagattgggggctgtgagtacgctgactgtggggttgcccacggctcctcctgtcctttgtcacctttgggctttagtgctcagagttgtttctagtttccctctaacttttatctt

SEQ ID NO: 32362 - DNA, 411 bp, Homo sapiens
gcagggccagggaaccctcagggtgatctagacccaggggacaacatgatcaaaagtatggaaatgtaaggctgtgatgtgatggggcataccaactgtttagcgcagaggtcacctgtaatcccagcacttagggagcagaggccagaggatagctagagcccaggagtttgagacctgctcaggcaatacagcgagccccctttctccacaaaaaggggaaaaaaaagacaaaaaaacccaagtgtagagcagaggtcagcaaaccggcttgcatgccaaatccagcctgctgcctgcttttttaaggcccacaaggtaagaattgttttcactttcttttgagacaggtctcagtctgcactccagcctgggtgacagagtgagactgtctcaaaaaggaaaaaaaaa

SEQ ID NO: 32363 - DNA, 520 bp, Homo sapiens
gctctagactgaacacgggaagactaactcaaagtccacacactgaagggtgaaatttccaacgttccttcttttctcagtttcctgaatgctgttagctaagtataaatgtctgagttgaaaaagaggcttattctctggagaagccaaccaaccaaagagaaaaaggcctgcacatacatttttggatcctctgatgaaattgccaggaatctgccaaataatcaccagggagcccattcgttgatgagttttgcccatatatacacaggtcccagacacattccagagcttttctttgaaatacaaagagagctaacgattgtcagatatgtgaggaaagaccagaacaggtaaactgaaaaacaaggaaataaaggcaatgtgaattttgacaaatagaagtaggaaaaaaaggcaatgtaaataacaaaagaaaaggtcacaaaatcatagtatctgaatttagagcgaagatactgtatccatgcaacaataacaggaaacttaaaaaaaaaaa

SEQ ID NO: 32364 - DNA, 357 bp, Homo sapiens
ttgcagaaatacttaagtgccttactataatgtcttgctaaggacatggctcatgcagaagagttgggtgaagacttgaaaacagaaattgagaaagagtatgaaaactgtggcaaaactggaaaatgtgaaatgttacgaattcctggtacatggaaggatacctaatgataggctttaaatttctattatcaggtatttggatagcttaagctatatctctcctcttacagtggaaataaatcaacgtagcatagcaaattaaaactcaggttttggaatgactatagaatagagtgactttgaacaaataactctctgaatagcagtgggctggaaaactagctctccacaaga

SEQ ID NO: 32365 - DNA, 722 bp, Homo sapiens
ggacttattcatttcaccgtggttagcaatgatgctgtccagcacagtcacacagctagctgacaaaataaagcccaccagcaacccaggagagacagacttccctttctcacacccatctctgattgttacataaagggcttgaaacctaatgacaatgtcataaataggtattttatgaaagctgcagaaatcttcctacaatggttcctaaagcaaaccttgggtaaggaatgagcctgatgttgaataacccaataattgagccatgtggtattttcagattgtcttgaaattacatcttaaacaatctggtcgggacaatggatgctgactaactgccctgtttcctgtactacagcaattggggaactcagggtttctatggcttcctttataagcctcttaattctaaacaaagccacaacccaaccaggaacatgctggcctctctgacacaaatgattacagctgctgctgatgcattttataatatggaagccaagcttgttctttgcatgagtttaaaaatccattatagctttagaatgttttaaacaatagcaaacgaagctctattgtggatacagtttttttttttgtttgtttgtttgtttttttgagacagagtcttgctctgtcccccaggctggagtacagtggcgtgatctcggctcactgcaagctcctcctcccgggttcacgccattctcctgcctcag

SEQ ID NO: 32366 - DNA, 402 bp, Homo sapiens
atcccagcactttgggaggccgaggcgggcagatcatgaggtcaggagatagagaccatactggctaacatggtgaaaccccatttctactaaaaatacaaaaaaattagctgggtgtggtggcacgcggctgtagtcccagctactcgggaggctgaggcaggaggctgagggaggagaatcatttgaacttgggaggcggaggttgcagtaagccgagatcgcaccactgcactccagcctgagtgacacagcgagactccgtctcaaaaaacaaacaaaaaagaacgttgacaaaattaaaatattttgttatggaattgtatgtggtgttaaaggtattgtttgtgaaatgtatgtgttaaaaataataaaatttcagagtaattactttcatgttgt

SEQ ID NO: 32367 - DNA, 329 bp, Homo sapiens
tgttttctaattctcgaacttaaaaataaactgaatacatatattataatgcaaaatttaaaactaacttcgtgtgactggagtaaatcggaattttgtttggtatgtacattttaaacttgctctttcagaacaacaaattctcagtcccacaaatgtgaatcgtttttgtacatttttcattatatctggctacactggtggctgatactatttttttaaggtttgtcattggttggtttttttgttgtttgagacagagtcttactctattgcactccagcctgggtgatggagtggacagggtgagactccatctcactccacca

SEQ ID NO: 32368 - DNA, 445 bp, Homo sapiens
tgttttctaattctcgaacttaaaaataaactgaatacatatattataatgcaaaatttaaaactaacttcgtgtgactggagtaaatcggaattttgtttggtatgtacattttaaacttgctctttcagaacaacaaattctcagtcccacaaatgtgaatcgtttttgtacatttttcattatatctggctacactggtggctgatactatttttttaaggtttgtcattggttggtttttttgttgtttgagacagagtcttactctattgcactccagcctgagtgacacagcgagactccgtctcaaaaaacaaacaaaaaagaacgttgacaaaattaaaatattttgttatggaattgtatgtggtgttaaaggtattgtttgtgaaatgtatgtgttaaaaataataaaatttcagagtaattactttcatgttgt

SEQ ID NO: 32369 - DNA, 546 bp, Homo sapiens
  misc_feature (67)..(67): n is a, c, g, or t
agaatcgagtcggacctcggaggtgtatcataatgccaggtactgtcctaggcattatggatataanacagtaaatttctttgttttgaaattagtggaggagaaccagagagatgccaggagaccagttagttgggagatgactgtagttagagatggtggtagcttcaaaggtagtggaatgagataagtggaaataattgagtagctggagtcaactggactggagatggattggaaatggagggcatgagaaggggtgaagttaaggatcacacttcagctgggcacagtggctcatgcctgtaatcccagcactttgggaggctgaggtgggtggattgcttgagtccaggagttcgagaccagcctgggcaaacatgatgaaaccccatctctacaaagaatacaaaattagctgggcatggtggtgtgggcctgtggtcccagctactcaggaggctgaggcgggaggatctcctgagcccaggagtttgaggcttcagtgcgccatgatcacgccactgcactctagcctgggtgaca

SEQ ID NO: 32370 - DNA, 667 bp, Homo sapiens
gcggcgcctactactactaaattggcggccgctcgacaaaaggatggagtctggagactaaatttgggagtggggagacatggtgtgtcctgcacctggaaatgtagatagacctcaggccatacaatacctggaggctatggtaagcatctttagtaagagcaagggggagtgttgtgagcactgtcacagtaaatttctttgttttgaaattagtggaggagaaccagagagatgccaggagaccagttagttgggagatgactgtagttagagatggtggtagcttcaaaggtagtggaatgagataagtggaaataattgagtagctggagtcaactggactggagatggattggaaatggagggcatgagaaggggtgaagttaaggatcacacttcagctgggcacagtggctcatgcctgtaatcccagcactttgggaggctgaggtgggtggattgcttgagtccaggagttcgagaccagcctgggcaaacatgatgaaaccccatctctacaaagaatacaaaattagctgggcatggtggtgtgggcctgtggtcccagctactcaggaggctgaggcgggaggatctcctgagcccaggagtttgaggcttcagtgcgccatgatcacgccactgcactctagcctgggtgaca

SEQ ID NO: 32371 - DNA, 1052 bp, Homo sapiens
  misc_feature (7)..(7): n is a, c, g, or t
  misc_feature (39)..(39): n is a, c, g, or t
  misc_feature (89)..(89): n is a, c, g, or t
tcagctntgttgtgggacaaacaacctggagtgtagcanggtgctgcatatttgcaggacagtatgaaagcgttctggagatggatggnggacatgtctgtacaatgtgggggatgcacttaataccactgaatttttcctttgaaaatggctaaaatagtagattttgtatgtattttaccacagtaaaaaatcaagctggccgggcatggtggcttacacctgcaatcccagcactttgggaggccaaggcgggcagatcacttgaggtcaggagttcatgaggaaagtttgagctgcagtcatagatacatagaagttagctagctaggcagagggagggtattgcattctggaaagagggaatagcacatacaaatgcctagtggttggaggaattgtgatgcttttaaagaactgtaaaaaggatggagtctggagactaaatttgggagtggggagacatggtgtgtcctgcacctggaaatgtagatagacctcaggccatacaatacctggaggctatggtaagcatctttagtaagagcaagggggagtgttgtgagcactgtcacagtaaatttctttgttttgaaattagtggaggagaaccagagagatgccaggagaccagttagttgggagatgactgtagttagagatggtggtagcttcaaaggtagtggaatgagataagtggaaataattgagtagctggagtcaactggactggagatggattggaaatggagggcatgagaaggggtgaagttaaggatcacacttcagctgggcacagtggctcatgcctgtaatcccagcactttgggaggctgaggtgggtggattgcttgagtccaggagttcgagaccagcctgggcaaacatgatgaaaccccatctctacaaagaatacaaaattagctgggcatggtggtgtgggcctgtggtcccagctactcaggaggctgaggcgggaggatctcctgagcccaggagtttgaggcttcagtgcgccatgatcacgccactgcactctagcctgggtgaca

SEQ ID NO: 32372 - DNA, 391 bp, Homo sapiens
catctatttttttttatcctccattcttgccttcttttagatgtattccagttcatcctaggatttgcttattagttacacattctttaaaaaattccgtttagtaggccagtcatggtggctcacgcctgtaatcccagcactttgggagaccgaggcgggcagatcacgaggtctggagattgagaccatcctggctaacacggtgaaaacctgtaactactaaaaatacaaaaagaaattagctgggcgtggtggtgggcgcctgtagtcccagctactcaggaggctgaggcaggagaatggtgtgaacctgggaggtggagcttgcagtgagccaagatcctgccactgcactccaggctgggcgacagagcaagactccgtttcc

SEQ ID NO: 32373 - DNA, 160 bp, Homo sapiens
atgaatgtgtcacacttctgaggttaatgataaatgaattggtcctgcttacctcaggaaaaactttcaagtctttctgaaaaactaatttaattcagtagtattttctaagatttaggttatgtttttaatcaatttggaaaccaagatttacttatag

SEQ ID NO: 32374 - DNA, 712 bp, Homo sapiens
aagtggcggatggcctgtccaaggggcgtcttttccatgaccacctggataccgaccggaatagatgtacccattgttttcagagatcggatgacagacagcagaaaactgtagtccctgagtgaaggaaagaaaaaatgagataagccctatgattgctctagtttgctgcctggagccagtgtccaggcccctctgaaggcaggggagccctgatactgaactaggaaaagacattgcaagaaaagaaaactacaaacatctctcgtgaaatgcttaacaaaattagcaactaaaatctagcaatatgttaaaagtataatacatcatgatcaagtggggtttattcaagaaacacaggtaagctcaacattcaaaaatcaggcaataacctttactacataaataaactaaaaagaaaaacatatgatcatgtcaatggatacaggaaaaacttttgacaaaattaatacccattcatagttttaaatggaaagaaaagctctcataaaaataggaatacaagatgacttcctcaacctgacaaaggacatctaccaaaaattcttctgttagcataatatttcatgatagaagactgattgcttttaccttaagatggcgaatgtggggaggatgtctactctctctacttttgttccacattgtactggaggtcatagccagagaaacaagactagaaaaaaaaaaa

SEQ ID NO: 32375 - DNA, 350 bp, Homo sapiens
taattttaatttaggcccatctaactgttgaatttacattagcaacagctaatcagtgagtgtttatgaaaaactttagtcacaggtaagtcccaaattaggaagaagctgtgttccaaagatttgtaaatattttgcttattttaaactcaaagtatatttttccatagaaaaaatttatgattggtgtttcagtcccctggcaagaccacaaatgcctcttaatgcatgcagatgtcctgatcatactgttaaacctaatctttgcgaccaacaacgtatttaggctctgctattaactgtcatttaacctttctgagcctcacttccttctgtaaagtaaagagatt

SEQ ID NO: 32376 - DNA, 422 bp, Homo sapiens
tccagccaggaatgcataatccatatattataatgaagaaacaagtagacaaaccccaaatgaagaatgttctattaagataaaggggaagattgaattcttcaataatatcaacaccatgcagacaaagaaaggctaaccattcccgattaagggatactagagagaaacaacaaccgaatgcaatacagcattcttagacttgatcctgtgctagaggagaaatggcatctaaagggtgttactgagacaagtgacaaagtaactttgataccacattggatcagtgtgaaatttaatgcagtggataactgtactgtgggaggaaacacactatttaggggtagaggaacatgaggtctgcaacttattctcaactagattggaatcaaagtcatctgtatataccttaaatagagaga

SEQ ID NO: 32377 - DNA, 2311 bp, Homo sapiens
  misc_feature (574)..(574): n is a, c, g, or t
tatttagtaaatatttgataaactaatgataagccattatagcttataccattttccatttctcaacaattcaaataatcaccatgtactatgctttatgtcttgctttgcttttctgtaggaaaactttggaccttattgagaagaggaaaacacttaattgggcagaagtcctagtggcacccaccagagctctactgcattcagacactgttcacacactgaccattcatgtgtgttcagcatctgaacttggccttgtgacgtagagaccctgatgaaagctaatgtttctgttttcatgaaaatattcaatctagggaacaccttagaggaaaaaagacttttaggtaagattggtttggaaattgggaatgacccagcttgtgcctatatatgtgggcctgcaatcaacttctgtggtaggagtgagttgcctacctgaagggaaactttttacataggatttaaaaagatgatactaatttaaaaacaaacaacattttaaataggttcaaagctagtgaaagtaaaaataaactaattaatattaccccagtattaagaatttagnacacctacaaccatctgatcttcaacaaacctgacaaaaacaagcaatggggaaaggactccctatttaatcaatggtgctgggagaactggctagccgtatgcagaaaattgaaactgaaccctttccttacaccttcatacaaaaattagttccagatggattaaagacttaaatgtaaaacccaaaactataaaatccctagaagaaaatctaggcaatactatctgggacataggcacaggcaaagattttataatgcaaataccaaaatcacttgcaacacaagcaaaaattgacgactgggatctaattgaactaaagagcttctgcacagcaaaagaaactatcaccagagcaagtagacaacttacagaatgggagaacatttttgcaatctgtccatctgacaaaagtctaatatccagagtctacaaataacttaaacaaatttacaagaaaaaaccccattaaaaagtgggcaaaggacatgaacagacacttctcaaaagaagacatgcatatggccaacaaacctatgaaaagaagctcaacatcactgatcattagagaaatcctaatcaaaaccacaatgaaataccatctcacaccagtcagaatggcaattattaaaatgtcaaaaaaaaaaaaaataacagatgcttccgaggttgtggaggaaaaggaacacctttacactgttgctgggagtgtaaattagtttaaccattgtggaagacagtgtggcaattccccaaagatctaaaagcagaaataccatttgacccagcaataccattgctgggtatatatccaaaggaatataaatcattctattataaagatacatggatgcgtatgttcactgcagcactattcacaatagcaaatatgtggaatccatccaaatgtccatcatagactggacaaataaaatactgtacacatatatatacacaccatgaaatactatgcagccataaaaaagaacaagatcttgtcatttgcatggatatgcatggagctggaggccgttatccttagcaaactaaggcaggaacggaaaaccaaacagtgcatattctcacttataagtgggagctgaatggtgagaacacatggacacatagggggaacaacacgccactggggcctgttgaggaggggagggagagaatcaggaagaatagctaatggatgctgggcttaacatctaggtgatgggatgatctgtacagcaaaccaccacaccacacatttacctatgtaacaaacctgcacatcctgcatatgtaccccttaaaagctgaagataaaaaattgttttttagtggtttctacctgtaatctcactttgggaggctgacgcaggaggatcgcttgagcccaggagtttgagaccagcttgggcaacaaacaaagggagatcccatctctacaaaaaattaaaaattgctgggcacggcggtttacacctgtaatcccagcactttgggaggccaaggtgggaggatcgcttgagtccaggagatcaagatcagtttaggcaatatagtgagaccctgtctctacaaaaaaaatttaaaaattagccaggtgtgttggtgtgtgcctgtagtcccagctacttgggaggctgaggtgggaggatcacttgagcctgagaggtcaaggttgcagtgagccatgatcatgccacttcaccccagcctgggtaacagagcgagaccctgtctc

SEQ ID NO: 32378 - DNA, 736 bp, Homo sapiens
gtggctcacatctgtaatctcagcacttcaggaggccgaggcaggcggatcatgaggtcaggagttcgagagcagcctggccaacatagtgaaaccccatctctactaaaaatacaaaaaattagccgggcacggtggcgggcatctgtaatcctacctactcgggaggctgaggcaggagaatcacttgaacccaggaggcggaggttgcagtgagccgagattgcaccattgcattgcagcccaggtgacagtgcaagactccgtctcaaaaaaaataataaaaatgaagtaccatttttttcacagattaggctgacaaacactggaaagaatgataaaacctcatgtggatgagcgttggcaagttggactcacattgctacaattcttctggagagttaaaaaaaaaaaaaaaaaaaagaaaaaaaattttgggggggctggggcctcggaaagacggttcaccaaacaccaaatatcggctgagggagacgcggcgggcgccaagagcaggggtaacggcgcaacaggtggacaaacagggtacccaaagggagaccccggggcaaccacgacacaagtgatggggattaccaccaagctaaaaaaaaacgcccggagggcacaccggcggcgtctgtgaaacacccaagagggggtctggagggcacatcacggggcactaccacgaggggccacgcgagcgctgataaaattcgcgcgccctggggta

SEQ ID NO: 32379 - DNA, 687 bp, Homo sapiens
ggacagggcaggaggcttctgagcgtgtggcccctagctagggaggcaccgaggcgggagagggagcccaggccactttcccagcctgggttcctggctcccccgccttgactgtgcaggggtgtctggttgaggagggaagtcctagatcagtccccagtcccagtcctcggagggtttgctctttctggaagtccttggctcaggatccttggacttgtctgtgggtttggttcttctcctggttgtctggatgggaggggaggggcctaggcttgctggggctgtgtgtagggtcaaaggcactatggatcctaatggagaacctcagggcaaaaccaacagtactgccatacccatggatgtggtgcaggttcggttccaaaccatagcaaagcaaatatagcaataaagcaagtcacacaagttttttggtttcccagtgtgtataaaagttatgtttgcactatagttgattaggtgtgcaatggcattatgtctaaaagagcgtataccttaattttaaaatattttattgataaaaatgctaacacagagacatgaagtcagcacgtgctgttggaaaatggcactgatagacctgctcaatgctgggttgccacaaacattcaatttgtaaaaaaatctaacctgcggagcataataaagcaaagtgccataaaagga

SEQ ID NO: 32380 - DNA, 750 bp, Homo sapiens
tatataattaaagtacattaggtttagtgattgcaatttgagaaaccaatgtcctttcttattgaaaaaggccctggtacagaaagtgttctatcttcctcacaagatctgaggtcaaaggagagattttgaaacattatagcaatggcttctagttattgaataaagaatgtcatttgctcctcacaggacccctttcagggagatttcacatattgggaaacagcctcatgagctttctacaaacatctttgtccttaagtcttcccatttcagtaattggctgtaccactcatccagcagctttcaaagttagaaacctggcaatcttcctttaacatccatttccctttccctcattcccccatatccaatcatgtgtattggaggtttttccacctctaaacttgagaacccatttactttttctccatctcctttgccatcacactagtccaagtgaagtgtttcatcatctcatttgcagcatcctttagtttaccctagattatcaatttttgtccccctcccaattcagtctctactcatgagctaacatgagtttattaagtgttcattctgaccatgccattccttgctcaaaattctctagtgccttcccaatgcccttaaaataaaattcctcatatggcctttgtggatctgcactcctacctcttctcctattgcaaccaaccctgttacctttttctcttttcacactggtcttcattctgtgctgcaaactgg

SEQ ID NO: 32381 - DNA, 618 bp, Homo sapiens
atggcggcagcggctgggggcgcggcgagccgccggggtgccgggcggccctgccccttctccatcgagcacatcctctccagcctgcccgagcggagcctcccggcccgggccgcctgcccaccgcagcccgccggtcgccagagccccgcgaagccagaggagcccggggcgcccgaggctgcgccctgcgcctgctgctgctgctgcggcccccgcgcggcgccctgcgggcccccagaggcggccgccgggctgggcgctcgtctggcgtggccgctgaggctgggaccggcggtgcccttgtctctgggtgcgccagccggaggttccggggcgctcccgggcgcggtcggcccgggttcgcagcggcgcacgaggcgccaccgcaccatcttcagcgaagagcagctgcaggcgctcgaggcgcttttcgtgcagaaccagtatcctgacgtgagtacgcgcgagcgcctggccggccgcatccgccttcgcgaggagcgcgtggaggtctggttcaagaaccgccgggccaaatggcgacaccagaagcgcgcgtcggcttccgcgaggctcctgcccggcgtcaagaagtccccgaaggggagctgctga

SEQ ID NO: 32382 - DNA, 399 bp, Homo sapiens
attcccatgagaagtggcctctgttgggagcctagaaagctcgattaacatactgaaaccacctaaggaagaataactgacccacttcctctctcattatcccatcctgggcccaccttctttctgtgactccctaagaacattcccctgctatgttctgtctttgccaggcgtggatctttatttcacatttgggttctaaatttcaaacccagctcagtctggtagttttaacagttgtagggggctgggggtggaatgtgtttgaattctgagaaaaagtgcgcaaaaatcttcttggaaatcagcattgttcccattcatcattgtggctcctaatttgatttgatgagttaaatagaaataaatcaaaaacatgtggatcaaatttatgttaaa

SEQ ID NO: 32383 - DNA, 314 bp, Homo sapiens
agtcatctttttaaaacattcctccaggtttatgtgtgtatgctcacaaaagacacaaagagttaagtcaaaatgtacggagaccaggaaggcgagtctatcagtagcagcaaaatgaagatgtgaacaatcagaagtttgaggatcagacagtgaccttctgctccaggctacagtaaatcagaaaggcacaaaattttgaaggaagaaaaaagattcatctttatatatattttttccctaactgctatacaaagccccaaagcctggaagtgttaattattatatgatcaatagtcctagccaaaaagaaa

SEQ ID NO: 32384 - DNA, 606 bp, Homo sapiens
ctgctgccatttcctctgtccctgaggtctccagaagagaaaggagctccagccttgcattctttgggtgtggagaggagcagagcagaatggagcctgcaggtcatgccaggagtcaccgcaaggctgtggctgtcagctcagaattccatcatcacttgggagatttctgcgaatcatcactaaagccattcactttctcataactaaacaagaatcttcttctggagttaagtatcagatatgaatgttctcactgacctcaggaagcaaaagtcctaaatcattatatggcagtgaaggtacaaaaaaaaaaaaaaatcagcaggaaataaagcggaactgctgccaacacatacaagctgcagtagcacccacaaaatgtgtagtatctattctaacacattcattggactgattacattggctcatagacttggttaactctggaagaacataataggtgtttattgtttactatggggatgggaaacataattaagtctatagtctccaattcttctcaagttcaaatgaaaccaacaattttggttttgtcttaacattcaggatgtgtttctaattaaactgaaatcacagtaagca

SEQ ID NO: 32385 - DNA, 428 bp, Homo sapiens
ttttctcatctgcaaaatgaccagtttgaactagatattctttgaggtagattccacgtgcagcgtttaaaagtctttgctcagtctgttgtttcagtgggctcttcaagcaccaacaggggccaatcaggaaggtaggacctgcctgatgtcaactcagggcacgtcccacaatatttccaggtgtcttcaggaatatggagcaccactgtcaccccgtgtcacctgtaagatgggagaagggaacccagtcaataaagattatgaggagggccgggcacgtaggctcacgcctgtaatcccagcactttgggaggccaaggtgggcagatcactgggtcaggagtttgagaccagcctggccaaaatggtgaaacctccatctctactacaaatacaaaaattagctgggcatggtggtgggcgcc

SEQ ID NO: 32386 - DNA, 1118 bp, Homo sapiens
acctggttgtctttggtcagacaagtgccctgagcatcgaagagtcatgcaggcctggagataaagtccctccaattaaaccaaatgctggggaagaatctgtcacgagtcttgacaaattgagatttgctgatggaagaagcataagaacatcggaactgcgactcagcatgcagaagtcaacgcaaaatcatgctgccgtgttccgtgtgggaagcttgttgcaagaaggttgtgggaaaatcagcaagctctatggagacctgaagcatctgaagacgtttgaccggggaatggtctggaacacggacctggtggagaccctggagctgcagaacctgatgctatgtgcgctgcagaccgtcaatggagcagaggcggggaaggagtcacggggcgcgcacgccggggaagactacaaggtgcgccttctcgccacgcccacctgcacctgccttttcctcccgcctggtgggactcagccccacccctgcattttctctgcattttatgtcgtttccccaaaagtatatccaaaaaatgcctttttccctctggtaactttgatccctgggttctcgccattttctggatcactgtgacctgttccttgctttgggtcggcatccactgatgccagcagtggcatctccaagccaatgtgctttgctgttagaaggccaaggttagaagtgcagccagcgtggcatgaccaggaaataaatgccagtttattaaataacgagtaagccaccgtttcaagcctgccctgtggaggaaatgccagtttattaaataacgagtaagccaccatttcaagcctgccctgtggaggaaatgccagtttattaaataacaagtaagtcaccgtttcagacctgccctgtggaggaaatgccagtttactaaataacgagtaagccactgtttccaacctgtcctgtggtttggaaaaggtattatagagcctgtcctgtggtttgattacggagcctgccctgtggtcacttgttcttcagatgaactgatttttgtgcagagcacacgtgttggattctgcctggtaagagtttttcacatatgatagcaaaaaacgacggaaagggaagcttggggtg

SEQ ID NO: 32387 - DNA, 712 bp, Homo sapiens
  misc_feature (648)..(648): n is a, c, g, or t
gtgcagtggtgcagtctcagctcactgcagcctcaaactcctgggcagctcaggtgatcttcccgactcagccttctgagcagttggggctacagagacagagttttgccatgctgcccaggctggagtgcagtggtgtgatctcggctcactgcagcctccacctcctgggctccagcagtcctcccacctcaacctccctaagagctgagactacagtgcacagccagagaacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcagtacaaagattagactctgaagtaatatctggactctgaaattagttccttaatgacaacacaaaggggagaatcctacccactgtgagagtcatgactcttgattgcagctgacagaaactcatgacagcctgctttatatgaaaggggagagaaagactggangatctttggagtggggttccacctctttgaggaagacaagagaatcttgtgacacgcggtgggg

SEQ ID NO: 32388 - DNA, 1411 bp, Homo sapiens
gtgcagtggtgcagtctcagctcactgcagcctcaaactcctgggcagctcaggtgatcttcccgactcagccttctgagcagttggggctacagagacagagttttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagagaacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggtagaatgtgttcattaccttctgcgcattataccacaaaaaagctgggaataaaaatgctaaccaaaaaaaaaggtgaaagtagataaaatttctcaactgtgtgatgggtaaacgtgcaggtttgctgtcatgctttgtttatgaagctgtggggtacaaggactctcatagtcactgtggaatgcagaacgttgcagcctcatggaagaggatttggcagcatctaacaaaatgacatggcatttgcccttagactcagcaattctagaatctgcctcaaaaaaaactctggcaaagaaatgaaaggactttacccacagagttcttttcacagcctgaatgtgtttgccacaaagttcttcactgtggcatttgtaaaactggaaacaatcaaaatgtccatcagtaggggattgggaacattaattcgtgcagtggggaactccgtaccagaaggaggaatgaggaacgcctattgataaggggcagagtacatatcatatgatgcaaatatatattgctttttcttaaaacagtacaaagataaaagtctaaagtggttgctgtggaggacaggggtcagtggtggaagtgagaccgaaatagactctgaagtaatatctggactttgaaattgttaagtgttttacatattaccaaactaagtttttaagatagtccctaaaattgaaagaatggtatctgaaatga

SEQ ID NO: 32389 - DNA, 1054 bp, Homo sapiens
acctggttgtctttggtcagacaagtgccctgagcatcgaagagtcatgcaggcctggagataaagtccctccaattaaaccaaatgctggggaagaatctgtcacgagtcttgacaaattgagatttgctgatggaagaagcataagaacatcggaactgcgactcagcatgcagaagtcaacgcaaaatcatgctgccgtgttccgtgtgggaagcttgttgcaagaaggttgtgggaaaatcagcaagctctatggagacctgaagcatctgaagacgtttgaccggggaatggtctggaacacggacctggtggagaccctggagctgcagaacctgatgctatgtgcgctgcagaccgtcaatggagcagaggcggggaaggagtcacggggcgcgcacgccggggaagactacaaggtgcggattgatgagtacgatcactccaagcccatccaggggcaacagaagaagccctttgaggagcactggaggaagcacaccctgtcctatgtggacgtcagcactgggaaggtcactgtggaatatagacccataatcgacaaaactttgaatgaggctgactgtgccactgtccccccagccattcactcctactgatgagacaagatgcggtgatgacagaatcagcttttgtaattatgtataatagctcatgcatgtgtcaatgtcataactgtctttatacgcttctgcactctggggaagaaggagtacattgaagggggattggcacccagtggccggggagcgtggcactttgtcccttgcttcattcttgtgacaagataaaactgggcacagctcttaaataaaatataaatgaacaaaatttcttttatttccaaatccatttaaaatattttactgttgtgactttagtcatatttgttgacctaaaaatcaaatgtaattatctttgtattctgttacatcaaaatccagatattttgttgtagtttcttttttttttttttcttgggaacgggtccggggcggggggccggtcccagttaatcggaggctctcaa

SEQ ID NO: 32390 - DNA, 1843 bp, Homo sapiens
agctcggtaccccgaccatttcaaccacacaaggacccagctaagaaacttcccctggttctgtcaccatcagaggaagcctgagctcctacatctctgtcctgcactttttcactttagtaacgaccctccaggctcggtagctgatgcctgtaatttcagcacttgggacgcttgaggcaggatgattgattgagcccgggaagtcaaggctctggcgagctgtgatcacaccattacgctccagcccaggtgacatagcgagaccctgtctcaaaagaaaaaaaaagtgtttttaataaaaacaggctgaaagaaaggattgaggtagtctcccagcgcttggagcaaaaagacaaagtatttgacaaactcttaggtacataaaggatgtctaagggaacatgcggacatggattactctggactcactgctggctgcacattgctggccagccatgtggcctctgtgcgttctgaacgtgtgatggtgccaacctcctgggctgaagtggaaatggaatgggttctagggcatctgtctcttagatcattttaacgtttgctgtgttttttctgtattgctctgttagagtaatgagaaatgtgatggtgtttctgggctcaggtgcggattgatgagtacgatcactccaagcccatccaggggcaacagaagaagccctttgaggagcactggaggaagcacaccctgtcctatgtggacgtcagcactgggaaggtcactgtggaatatagacccataatcgacaaaactttgaatgaggctgactgtgccactgtccccccagccattcactcctactgatgagacaagatgcggtgatgacagaatcagctttttgcacagccagagaacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggtagaatgtgttcattaccttctgcgcattataccacaaaaaagctgggaataaaaatgctaaccaaaaaaaaaggtgaaagtagataaaatttctcaactgtgtgatgggtaaacgtgcaggtttgctgtcatgctttgtttatgaagctgtggggtacaaggactctcatagtcactgtggaatgcagaacgttgcagcctcatggaagaggatttggcagcatctaacaaaatgacatggcatttgcccttagactcagcaattctagaatctgcctcaaaaaaaactctggcaaagaaatgaaaggactttacccacagagttcttttcacagcctgaatgtgtttgccacaaagttcttcactgtggcatttgtaaaactggaaacaatcaaaatgtccatcagtaggggattgggaacattaattcgtgcagtggggaactccgtaccagaaggaggaatgaggaacgcctattgataaggggcagagtacatatcatatgatgcaaatatatattgctttttcttaaaacagtacaaagataaaagtctaaagtggttgctgtggaggacaggggtcagtggtggaagtgagaccgaaatagactctgaagtaatatctggactttgaaattgttaagtgttttacatattaccaaactaagtttttaagatagtccctaaaattgaaagaatggtatctgaaatga

SEQ ID NO: 32391 - DNA, 1286 bp, Homo sapiens
cgggtctagccaggctcaggcaaccctccacctcagcctctgaatagctgggactgcaggaagactacaaggtgcggattgatgagtacgatcactccaagcccatccaggggcaacagaagaagccctttgaggagcactggaggaagcacaccctgtcctatgtggacgtcagcactgggaaggtcactgtggaatatagacccataatcgacaaaactttgaatgaggctgactgtgccactgtccccccagccattcactcctactgatgagacaagatgcggtgatgacagaatcagctttttgcacagccagagaacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggtagaatgtgttcattaccttctgcgcattataccacaaaaaagctgggaataaaaatgctaaccaaaaaaaaaggtgaaagtagataaaatttctcaactgtgtgatgggtaaacgtgcaggtttgctgtcatgctttgtttatgaagctgtggggtacaaggactctcatagtcactgtggaatgcagaacgttgcagcctcatggaagaggatttggcagcatctaacaaaatgacatggcatttgcccttagactcagcaattctagaatctgcctcaaaaaaaactctggcaaagaaatgaaaggactttacccacagagttcttttcacagcctgaatgtgtttgccacaaagttcttcactgtggcatttgtaaaactggaaacaatcaaaatgtccatcagtaggggattgggaacattaattcgtgcagtggggaactccgtaccagaaggaggaatgaggaacgcctattgataaggggcagagtacatatcatatgatgcaaatatatattgctttttcttaaaacagtacaaagataaaagtctaaagtggttgctgtggaggacaggggtcagtggtggaagtgagaccgaaatagactctgaagtaatatctggactttgaaattgttaagtgttttacatattaccaaactaagtttttaagatagtccctaaaattgaaagaatggtatctgaaatga

SEQ ID NO: 32392 - DNA, 1721 bp, Homo sapiens
agctcggtaccccgaccatttcaaccacacaaggacccagctaagaaacttcccctggttctgtcaccatcagaggaagcctgagctcctacatctctgtcctgcactttttcactttagtaacgaccctccaggctcggtagctgatgcctgtaatttcagcacttgggacgcttgaggcaggatgattgattgagcccgggaagtcaaggctctggcgagctgtgatcacaccattacgctccagcccaggtgacatagcgagaccctgtctcaaaagaaaaaaaaagtgtttttaataaaaacaggctgaaagaaaggattgaggtagtctcccagcgcttggagcaaaaagacaaagtatttgacaaactcttaggtacataaaggatgtctaagggaacatgcggacatggattactctggactcactgctggctgcacattgctggccagccatgtggcctctgtgcgttctgaacgtgtgatggtgccaacctcctgggctgaagtggaaatggaatgggttctagggcatctgtctcttagatcattttaacgtttgctgtgttttttctgtattgctctgttagagtaatgagaaatgtgatggtgtttctgggctcaggtgcggattgatgagtacgatcactccaagcccatccaggggcaacagaagaagccctttgaggagcactggaggaagcacaccctgtcctatgtggacgtcagcactgggaagtgcacagccagagaacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggtagaatgtgttcattaccttctgcgcattataccacaaaaaagctgggaataaaaatgctaaccaaaaaaaaaggtgaaagtagataaaatttctcaactgtgtgatgggtaaacgtgcaggtttgctgtcatgctttgtttatgaagctgtggggtacaaggactctcatagtcactgtggaatgcagaacgttgcagcctcatggaagaggatttggcagcatctaacaaaatgacatggcatttgcccttagactcagcaattctagaatctgcctcaaaaaaaactctggcaaagaaatgaaaggactttacccacagagttcttttcacagcctgaatgtgtttgccacaaagttcttcactgtggcatttgtaaaactggaaacaatcaaaatgtccatcagtaggggattgggaacattaattcgtgcagtggggaactccgtaccagaaggaggaatgaggaacgcctattgataaggggcagagtacatatcatatgatgcaaatatatattgctttttcttaaaacagtacaaagataaaagtctaaagtggttgctgtggaggacaggggtcagtggtggaagtgagaccgaaatagactctgaagtaatatctggactttgaaattgttaagtgttttacatattaccaaactaagtttttaagatagtccctaaaattgaaagaatggtatctgaaatga

SEQ ID NO: 32393 - DNA, 1198 bp, Homo sapiens
gtgcagtggtgcagtctcagctcactgcagcctcaaactcctgggcagctcaggtgatcttcccgactcagccttctgagcagttggggctacagagacagagttttgccatgctgcccaggctggagtgcagtggtgtgatctcggctcactgcagcctccacctcctgggctccagcagtcctcccacctcaacctccctaagagctgagactacagtgcacagccagagaacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggtagaatgtgttcattaccttctgcgcattataccacaaaaaagctgggaataaaaatgctaaccaaaaaaaaaggtgaaagtagataaaatttctcaactgtgtgatgggtaaacgtgcaggtttgctgtcatgctttgtttatgaagctgtggggtacaaggactctcatagtcactgtggaatgcagaacgttgcagcctcatggaagaggatttggcagcatctaacaaaatgacatggcatttgcccttagactcagcaattctagaatctgcctcaaaaaaaactctggcaaagaaatgaaaggactttacccacagagttcttttcacagcctgaatgtgtttgccacaaagttcttcactgtggcatttgtaaaactggaaacaatcaaaatgtccatcagtaggggattgggaacattaattcgtgcagtggggaactccgtaccagaaggaggaatgaggaacgcctattgataaggggcagagtacatatcatatgatgcaaatatatattgctttttcttaaaacagtacaaagataaaagtctaaagtggttgctgtggaggacaggggtcagtggtggaagtgagaccgaaatagactctgaagtaatatctggactttgaaattgttaagtgttttacatattaccaaactaagtttttaagatagtccctaaaattgaaagaatggtatctgaaatga

SEQ ID NO: 32394 - DNA, 1593 bp, Homo sapiens
agctcggtaccccgaccatttcaaccacacaaggacccagctaagaaacttcccctggttctgtcaccatcagaggaagcctgagctcctacatctctgtcctgcactttttcactttagtaacgaccctccaggctcggtagctgatgcctgtaatttcagcacttgggacgcttgaggcaggatgattgattgagcccgggaagtcaaggctctggcgagctgtgatcacaccattacgctccagcccaggtgacatagcgagaccctgtctcaaaagaaaaaaaaagtgtttttaataaaaacaggctgaaagaaaggattgaggtagtctcccagcgcttggagcaaaaagacaaagtatttgacaaactcttaggtacataaaggatgtctaagggaacatgcggacatggattactctggactcactgctggctgcacattgctggccagccatgtggcctctgtgcgttctgaacgtgtgatggtgccaacctcctgggctgaagtggaaatggaatgggttctagggcatctgtctcttagatcattttaacgtttgctgtgttttttctgtattgctctgttagagtaatgagaaatgtgatggtgtttctgggctcaggtgcggattgatgagtacgatcactccaagcccatccaggggcaacagaagaagccctttgaggagcactggaggaagcacaccctgtcctatgtggacgtcagcactgggaaggtcagtgtggagctcgttctcaccacagcccagcacccacacggccccgcccaggtctgcgggctggccttgctgatggtgaacgcagaggagcaggccagatttaaatcacctcccgacagatttgaggcaccgctgaaaaaggcactctgacagcagttgggcttcgggctggaaacagaatccagtgcctgcaggtggttcagaggagccttaaggaagggttgctccgtggtgtgggccagatggacgtcactgggcaggagcaagtgtccaaggcctggtggcaggggaagagatgatgattatggacctagcgagaagtcagcatctgtgtagtggggacagagccactaccagaaaccagtcccgagccaagggagcccagaagagacccctcccctctcttcccatgggctgggccaactggaagcatctgcaggggagcagaggggatgtggtgcagcccttagcatcccctgggcactgagcaagcagagaagggcagaaatggaggcagggttggggtaagcagcgtcctgggaacagccagccgagggtgtggtaggggggttgcagcttgttccacacaagcacagcgtcctgggaacagccagccgaggatgtggtagggggttgcagcttgttccacacaacgcagttcacccgtgtggcatttcccgctgggcattgagattcagaaatcatgaagatagaaagcttttacccttaagcttttcataacttgtaagggagagtcgtataatcacttagctgtgtctgtggaagttacctttggactctcactatcatctagtgtgtctgtgattcaggcagtaggtcattttcag

SEQ ID NO: 32395 - DNA, 1443 bp, Homo sapiens
agctcggtaccccgaccatttcaaccacacaaggacccagctaagaaacttcccctggttctgtcaccatcagaggaagcctgagctcctacatctctgtcctgcactttttcactttagtaacgaccctccaggctcggtagctgatgcctgtaatttcagcacttgggacgcttgaggcaggatgattgattgagcccgggaagtcaaggctctggcgagctgtgatcacaccattacgctccagcccaggtgacatagcgagaccctgtctcaaaagaaaaaaaaagtgtttttaataaaaacaggctgaaagaaaggattgaggtagtctcccagcgcttggagcaaaaagacaaagtatttgacaaactcttaggtacataaaggatgtctaagggaacatgcggacatggattactctggactcactgctggctgcacattgctggccagccatgtggcctctgtgcgttctgaacgtgtgatggtgccaacctcctgggctgaagtggaaatggaatgggttctagggcatctgtctcttagatcattttaacgtttgctgtgttttttctgtattgctctgttagagtaatgagaaatgtgatggtgtttctgggctcaggtgcggattgatgagtacgatcactccaagcccatccaggggcaacagaagaagccctttgaggagcactggaggaagcacaccctgtcctatgtggacgtcagcactgggaaggtcagtgtggagctcgttctcaccacagcccagcacccacacggccccgcccaggtctgcgggctggccttgctgatggtgaacgcagaggagcaggccagatttaaatcacctcccgacagatttgaggcaccgctgaaaaaggcactctgacagcagttgggcttcgggctggaaacagaatccagtgcctgcaggtggttcagaggagccttaaggaagggttgctccgtggtgtgggccagatggacgtcactgggcaggagcaagtgtccaaggcctggtggcaggggaagagatgatgattatggacctagcgagaagtcagcatctgtgtagtggggacagagccactaccagaaaccagtcccgagccaagggagcccagaagagacccctcccctctcttcccatgggctgggccaactggaagcatctgcaggggagcagaggggatgtggtgcagcccttagcatcccctgggcactgagcaagcagagaagggcagaaatggaggcagggttggggtaagcagcgtcctgggaacagccagccgagggtgtggtaggggggttgcagcttgttccacacaagcacagcgtcctgggagaatcgcttgagactgggaggcagaggttgcagtgaaccgagatcatgccaccgcacttcagcctgggtgacagagaaggactccgtctcaa

SEQ ID NO: 32396 - DNA, 1167 bp, Homo sapiens
aatgcctcctacgtgacggaaagcagatccgtggttccctgcagactggcaggagcagattccaaaggcacaggaagaagcttgcagtacaaagataaaaatctaaagtggttgctgtggaggacaggggtcagtggtggaagtgagaccgaaatagactctgaagtaatatctggacttttgaaatttgcacagccagagaacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggtagaatgtgttcattaccttctgcgcattataccacaaaaaagctgggaataaaaatgctaaccaaaaaaaaaggtgaaagtagataaaatttctcaactgtgtgatgggtaaacgtgcaggtttgctgtcatgctttgtttatgaagctgtggggtacaaggactctcatagtcactgtggaatgcagaacgttgcagcctcatggaagaggatttggcagcatctaacaaaatgacatggcatttgcccttagactcagcaattctagaatctgcctcaaaaaaaactctggcaaagaaatgaaaggactttacccacagagttcttttcacagcctgaatgtgtttgccacaaagttcttcactgtggcatttgtaaaactggaaacaatcaaaatgtccatcagtaggggattgggaacattaattcgtgcagtggggaactccgtaccagaaggaggaatgaggaacgcctattgataaggggcagagtacatatcatatgatgcaaatatatattgctttttcttaaaacagtacaaagataaaagtctaaagtggttgctgtggaggacaggggtcagtggtggaagtgagaccgaaatagactctgaagtaatatctggactttgaaattgttaagtgttttacatattaccaaactaagtttttaagatagtccctaaaattgaaagaatggtatctgaaatga

SEQ ID NO: 32397 - DNA, 813 bp, Homo sapiens
agacaagggttctcccacttttcatgatgggagcatttttgtaaagcaaagcactgagaatctggtacagtgtcattttcgttgctctgttccactctaccgatctgccgtcatttacagtcccctgttgcgcatgtagatcatttttgaatttgttattggaaaatactgcagcaaataccttaaagtttacatgccgtaaatctacttttatagttaaaatttttcaaaaggaacacaagagatggctttttgtacatttttgtgcttaacttaccactgacttcttttcaaggtcactgtggaatatagacccataatcgacaaaactttgaatgaggctgactgtgccactgtccccccagccattcactcctactgatgagacaagatgcggtgatgacagaatcagcttttgtaattatgtataatagctcatgcatgtgtcaatgtcataactgtctttatacgcttctgcactctggggaagaaggagtacattgaagggggattggcacccagtggccggggagcgtggcactttgtcccttgcttcattcttgtgacaagataaaactgggcacagctcttaaataaaatataaatgaacaaaatttcttttatttccaaatccatttaaaatattttactgttgtgactttagtcatatttgttgacctaaaaatcaaatgtaattatctttgtattctgttacatcaaaatccagatattttgttgtagtttcttttttttttttttcttgggaacgggtccggggcggggggccggtcccagttaatcggaggctctcaa

SEQ ID NO: 32398 - DNA, 3691 bp, Homo sapiens
ctgaccctgggagcgcggggagcgccaagcctcttctagcgctcacctcgcgctcactcctgcgctcgccgggctgcttgtgcggggaaggggcggggcccgcctgggctcctccccggtcggagcccggagcaagggggcagagcgcgccgggcgctggttaaagaggcgtgcggaggcgggcgcggcgcatactgctagtggcgcgcggaggagcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgggagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtggtatctgatgctgcaggacagggtgtggccatcacagggaaccagaccttcaacaactggaactggcccaatgcaatgatttttgcagcgaccgtcattaccaccattggatatggcaatgtggctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctgcggaaggcgcagatcacgtgcacagtcatcttcatcgtgtggggcgtcctagtccacctggtgatcccacccttcgtattcatggtgactgaggggtggaactacatcgagggcctctactactccttcatcaccatctccaccatcggcttcggtgactttgtggccggtgtgaaccccagcgccaactaccacgccctgtaccgctacttcgtggagctctggatctacttggggctggcctggctgtccctttttgtcaactggaaggtgagcatgtttgtggaagtccacaaagccattaagaagcggcggcggcgacggaaggagtcctttgagagctccccacactcccggaaggccctgcaggtgaaggggagcacagcctccaaggacgtcaacatcttcagctttctttccaagaaggaagagacctacaacgacctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtgggggggcagcctcggaactgggagtggggggccaggggccttcctaaccttccatcatcctcagctagatgtatgcccgggacagggcctctgttctccagctgaaccataccctggctgtgggggcatctgtcctgagcttggctggtgtatctcacaatgcaaagacatgctggctggcgggacaggtgggcaggactgaccctgaggaggccttgcctgcagggtctttgtctcaccatttggtggagtatcacacggttctctgaggtctggggcctcagctgtttaagtttaccggtattactgagctcggcatttggagagggagctctgaagtgtctggggaggtaccgctgtgcgtggggtcaggtgtttccgtaccacagcaggagcagggcccgcccgcatcccagctgtgggcctgccggtcaggtcgggcacctactacaaaccgtagtggggtggaggctgctggaggtgggagtgaggagatgagggcagggtctcaaacagtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagccgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagcccccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcaggggcctgaaaaggagcagcctcgtatttttctgtgaaatgttttaatgaaccatgttgttgctggttgtcctggcatcgcgcacactgtatgtacatactggcaacgatgtcaaatgtaatttattttaacatttttacaataaaacatgaggtggacaggc

SEQ ID NO: 32399 - DNA, 994 bp, Homo sapiens
ctgaccctgggagcgcggggagcgccaagcctcttctagcgctcacctcgcgctcactcctgcgctcgccgggctgcttgtgcggggaaggggcggggcccgcctgggctcctccccggtcggagcccggagcaagggggcagagcgcgccgggcgctggttaaagaggcgtgcggaggcgggcgcggcgcatactgctagtggcgcgcggaggagcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgggagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtcagtcgccgcctgtacccccatatacatctgaagctggcttgagctttagggggcgctgaaaggaagaccccttcacagctttgggtgaccctcagtccctgtggaaggtccagggggtgatgagagagcgtgtctcatcatgggtcaggcttcgaggatctgtcgctcacccgagggacacaggggtcccccaggcgcggagactctttggaacttagtttggccggagacaaattggagttgattcccggg

SEQ ID NO: 32400 - DNA, 3970 bp, Homo sapiens
ctgaccctgggagcgcggggagcgccaagcctcttctagcgctcacctcgcgctcactcctgcgctcgccgggctgcttgtgcggggaaggggcggggcccgcctgggctcctccccggtcggagcccggagcaagggggcagagcgcgccgggcgctggttaaagaggcgtgcggaggcgggcgcggcgcatactgctagtggcgcgcggaggagcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgggagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtggtatctgatgctgcaggacagggtgtggccatcacagggaaccagaccttcaacaactggaactggcccaatgcaatgatttttgcagcgaccgtcattaccaccattggatatggcaatgtggctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctgcggaaggcgcagatcacgtgcacagtcatcttcatcgtgtggggcgtcctagtccacctggtgatcccacccttcgtattcatggtgactgaggggtggaactacatcgagggcctctactactccttcatcaccatctccaccatcggcttcggtgactttgtggccggtgtgaaccccagcgccaactaccacgccctgtaccgctacttcgtggagctctggatctacttggggctggcctggctgtccctttttgtcaactggaaggtgagcatgtttgtggaagtccacaaagccattaagaagcggcggcggcgacggaaggagtcctttgagagctccccacactcccggaaggccctgcaggtgaaggggagcacagcctccaaggacgtcaacatcttcagctttctttccaagaaggaagagacctacaacgacctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtgggggggcagcctcggaactgggagtggggggccaggggccttcctaaccttccatcatcctcagctagatgtatgcccgggacagggcctctgttctccagctgaaccataccctggctgtgggggcatctgtcctgagcttggctggtgtatctcacaatgcaaagacatgctggctggcgggacaggtgggcaggactgaccctgaggaggccttgcctgcagggtctttgtctcaccatttggtggagtatcacacggttctctgaggtctggggcctcagctgtttaagtttaccggtattactgagctcggcatttggagagggagctctgaagtgtctggggaggtaccgctgtgcgtggggtcaggtgtttccgtaccacagcaggagcagggcccgcccgcatcccagctgtgggcctgccggtcaggtcgggcacctactacaaaccgtagtggggtggaggctgctggaggtgggagtgaggagatgagggcagggtctcaaacagtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagccgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagcccccttgggccaggcagggtgaggccaaattgctcttggcccacaaatgggtgatggtcagatatgtgaatcaagctcctttctctagctagtgtttgatgtgcacgtgtgtgtgcacagtgcgtgtgtgcacacgcacacctgtgcactcgtgtgtgtttaagaaaggaaaggatttgggctggggagcaaaagataatgtgaaactgttggtggactctctggtgaggggtgggcagaacttgctgctactagagttcttgggttctccatgatgttcaccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcaggggcctgaaaaggagcagcctcgtatttttctgtgaaatgttttaatgaaccatgttgttgctggttgtcctggcatcgcgcacactgtatgtacatactggcaacgatgtcaaatgtaatttattttaacatttttacaataaaacatgaggtggacaggc

SEQ ID NO: 32401 - DNA, 4114 bp, Homo sapiens
ctgaccctgggagcgcggggagcgccaagcctcttctagcgctcacctcgcgctcactcctgcgctcgccgggctgcttgtgcggggaaggggcggggcccgcctgggctcctccccggtcggagcccggagcaagggggcagagcgcgccgggcgctggttaaagaggcgtgcggaggcgggcgcggcgcatactgctagtggcgcgcggaggagcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgggagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtggtatctgatgctgcaggacagggtgtggccatcacagggaaccagaccttcaacaactggaactggcccaatgcaatgatttttgcagcgaccgtcattaccaccattggatatggcaatgtggctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctgcggaaggcgcagatcacgtgcacagtcatcttcatcgtgtggggcgtcctagtccacctggtgatcccacccttcgtattcatggtgactgaggggtggaactacatcgagggcctctactactccttcatcaccatctccaccatcggcttcggtgactttgtggccggtgtgaaccccagcgccaactaccacgccctgtaccgctacttcgtggagctctggatctacttggggctggcctggctgtccctttttgtcaactggaaggtgagcatgtttgtggaagtccacaaagccattaagaagcggcggcggcgacggaaggagtcctttgagagctccccacactcccggaaggccctgcaggtgaaggggagcacagcctccaaggacgtcaacatcttcagctttctttccaagaaggaagagacctacaacgacctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtgggggggcagcctcggaactgggagtggggggccaggggccttcctaaccttccatcatcctcagctagatgtatgcccgggacagggcctctgttctccagctgaaccataccctggctgtgggggcatctgtcctgagcttggctggtgtatctcacaatgcaaagacatgctggctggcgggacaggtgggcaggactgaccctgaggaggccttgcctgcagggtctttgtctcaccatttggtggagtatcacacggttctctgaggtctggggcctcagctgtttaagtttaccggtattactgagctcggcatttggagagggagctctgaagtgtctggggaggtaccgctgtgcgtggggtcaggtgtttccgtaccacagcaggagcagggcccgcccgcatcccagctgtgggcctgccggtcaggtcgggcacctactacaaaccgtagtggggtggaggctgctggaggtgggagtgaggagatgagggcagggtctcaaacagtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagccgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagcccccttgggccaggcagggtgaggccaaattgctcttggcccacaaatgggtgatggtcagatatgtgaatcaagctcctttctctagctagtgtttgatgtgcacgtgtgtgtgcacagtgcgtgtgtgcacacgcacacctgtgcactcgtgtgtgtttaagaaaggaaaggatttgggctggggagcaaaagataatgtgaaactgttggtggactctctggtgaggggtgggcagaacttgctgctactagagttcttgggttctccatgatgttcaccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcaggggcctgaaaaggagcagcctcgtatttttctgtgaaatgttttaatgaaccatgttgttgctggttgtcctggcatcgcgcacactgtatgtacatactggcaacgatgtcaaatgtaatttattttaacatttttacaataaaacatgaggtggacaggccagcttggtgtgtgctgtgtgtgggtcaggttagagaggggttggcttctggcctctgagcagcaggggagcctgggcgcatccacagaagatagagaggactcaggacagactgataagaggattggatggtctggaggggag

SEQ ID NO: 32402 - DNA, 449 bp, Homo sapiens
tcatgatcagagtatgatcaagggaaatatcattacttaagtactgacaatagatcaatatcaatttatcttagagaacgggctgtgtgtgtgttggaagcaaggcccactggtttgaccacccctcctgttcttggcctcactctctccttcctcaggatatggcaatgtggctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctggtatgtcccctaccctgggtgttgggcagagatgggggaaccatgacaggtgaggggaggacaggaggcctctaggaattggaccaagggtgtaaggacagatggcaagaggatagtttcagag

SEQ ID NO: 32403 - DNA, 1041 bp, Homo sapiens
atggatacaggccccgaccagtcctacttctccggcaatcactggttcgtcttctcggtgtaccttctcactttcctggtggggctccccctcaacctgctggccctggtggtcttcgtgggcaagctgcggtgccgcccggtggccgtggacgtgctcctgctcaacctgaccgcctcggacctgctcctgctgctgttcctgcctttccgcatggtggaggcagccaatggcatgcactggcccctgcccttcatcctctgcccactctctggattcatcttcttcaccaccatctatctcaccgccctcttcctggcagctgtgagcattgaacgcttcctgagtgtggcccacccactgtggtacaagacccggccgaggctggggcaggcaggtctggtgagtgtggcctgctggctgttggcctctgctcactgcagcgtggtctacgtcatagaattctcaggggacatctcccacagccagggcaccaatgggacctgctacctggagttctggaaggaccagctagccatcctcctgcccgtgcggctggagatggctgtggtcctctttgtggtcccgctgatcatcaccagctactgctacagccgcctggtgtggatcctcggcagagggggcagccaccgccggcagaggagggtggcggggctggtggcggccacgctgctcaacttccttgtctgctttgggccctacaacgtgtcccatgtcgtgggctatatctgcggtgaaagcccggtgtggaggatctacgtgacgcttctcagcaccctgaactcctgtgtcgacccctttgtctactacttctcctcctccgggttccaagccgactttcatgagctgctgaggaggttgtgtgggctctggggccagtggcagcaggagagcagcatggagctgaaggagcagaagggaggggaggagcagagagcggaccgaccagctgaaagaaagaccagtgaacactcacagggctgtggaactggtggccaggtggcctgtgctgaaaactag

SEQ ID NO: 32404 - DNA, 409 bp, Homo sapiens
gtttcaggatacaaaattaatttgcataaatcagcagctcttctatacaccaacagtgaccaagctgagaatcaaatcaagaacttaactccttttgcaatagctgcaaaaaaccccaaaatactttgtacctaaccaaggaggtgaaagacctctacaaggaaaactacaaaacactgctgaaacaaatcatagacaacacaaacaaatggaaacacatcccatgctcatggatgggtaaaatcaatattgtgaaaatgaccatactgccaaaagcaatctacaaattcagtgcagttcccatcaaaataccaccatcattcttcacagaactagaaaaaccaatcctaaaatccatatgaaacctaaaagagcctgcatagccaaagcaagactaagcaaaaataaa

SEQ ID NO: 32405 - DNA, 319 bp, Homo sapiens
tgtatttttagtagagacggggcttcactgtgttaagccagggtgatcttgatctcctgacctcgtgatctgcccacctcggcttgagccactgcacccggcctcaacattttcttttttagtgataggattaacattcattactcaccgaacaaacgtttgagctctttctatgtgccattgtatgcagagtgatgaaacaagataaacataatccctccctgatggatcttataattcggtgaagaagaaagatattaaatacgaaagtttgttgagaattagaataaggaaagtaataaagaaaatacattttctg

SEQ ID NO: 32406 - DNA, 138 bp, Homo sapiens
cctcaccacaacctcatgggtggtcggtcaatgtcgtaggcccgctttacagccgaggagacagaggcttccagaggcaaacacactggtccatgagtagcagaacgagggtaggcccaggaagccatgtccttggcc

SEQ ID NO: 32407 - DNA, 308 bp, Homo sapiens
tggttcctctttaaagttcgtagtagttagcagtagaagaaatagtgaaagtcttaaagtctttgatccttcttatagtgcatagaagaaaacgctgacgtatgctgccttctctctctgcctcagctacctaaaagggaagggccccctgtcccatgatcacttgacttgcttgaccttatcaatcacttagaagattcaccctccttaccctgcccccttgtcttgtatgcaataaatatcagtgcgcccagtggttcggggccactaccagtctctgcgtcttggtggtggtggtcccctgggcc

SEQ ID NO: 32408 - DNA, 164 bp, Homo sapiens
tctaaattgcagtgccttttgagtgaaagagagtgctgacaataaatatgttacaggagcaggtgttaagctggactatcccaggcaaattgggacatatggtcaccctagttaaagggtgctgttgtagctttgctaccttcttttttttaaatgagacggag

SEQ ID NO: 32409 - DNA, 3119 bp, Homo sapiens
aagacgcagtcttcagcaaggaagtgctgggaacgccctggagtgaacccaggaagatgcctgcagtgggtgccagggcccctctccaccgtccctgctgggcttcggggccacgcccgactgctgtgaacggcctgcggagcaccacgtgcgacggctggaggcgagaggtctgcctttgatgtggctgttggtgcagggcctgtggtgccttccgcagcggaaatggcgcgccgcccggggagggcgggagcagcgtcccgggtgcccctgtgaggatgagcgacgagatgactggagggtccctgaagacctcactagggtgcccccagccggtccgctcccaggaagcgacacccccacagccccagggctgcagctgagggggtcgccactctggctgggcgaggctgggcccttgggggcaggcgccagagtggcctcaggctctacaagatgcctgaaaacaccaacctctccagggctcactagcattggacgctttcacgctctgccctggccggaagccccctcaccccgcgcgatgtgcaaactcctgcagggctcactcagtttccagaactttaattattggaaagttctccctggtccagcccccaaatctgccgtgaacgttgacagctgagttgctgctccatgcgtgctttggctgagagcagaggggacccctgtcctccctgagctgctgacgaggggaggggtgaagggtggggcctctggagagggcaggtcccggggaagctccggactcctagaggggcggccaggtgggggccctggtgaccaggacagactgtggtgttttttaacgtaaaggagatccgcggtgtgagggaccccctgggtcctgcacgccgcctggtggcaggccgggccatggtgggtgctcacgcccccggcatgtggccgccctcagtgggaggggctctgagaacgactttttaaaacgcagagaaaagctccattcttcccaggacctcagcgcagccctggcccaggaaggcaggagacagaggccaggacggtccagaggtgtcgaaatgtcctggggacctgagcagcagccaccagggaagaggcagggagggagctgaggaccaggcttggttgtgagaatccctgagcccaggcggtagatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctggtgagcgcggtgcacgcggctttaagtgtgctgggcagagggaggtggtgatattgtgtggtctggttcctgtgtgaccctgggcagttccttacctccctggtccccgtttgtcaaagaggatggactaaatgatctctgaaagtgttgaagcgcggacccttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccaatgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtatggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccaccttagccccttcaaaaaagtgct

SEQ ID NO: 32410 - DNA, 2417 bp, Homo sapiens
  misc_feature (28)..(28): n is a, c, g, or t
gtcggcacgaggccctggtccagcccgncaaatctgccgagagggcaggtcccggggaagctccggactcctagaggggcggccaggtgggggccctggtgaccaggacagactgtggtgttttttaacgtaaaggagatccgcggtgtgagggaccccctgggtcctgcacgccgcctggtggcaggccgggccatggtgggtgctcacgcccccggcatgtggccgccctcagtgggaggggctctgagaacgactttttaaaacgcagagaaaagctccattcttcccaggacctcagcgcagccctggcccaggaaggcaggagacagaggccaggacggtccagaggtgtcgaaatgtcctggggacctgagcagcagccaccagggaagaggcagggagggagctgaggaccaggcttggttgtgagaatccctgagcccaggcggtagatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctggtgagcgcggtgcacgcggctttaagtgtgctgggcagagggaggtggtgatattgtgtggtctggttcctgtgtgaccctgggcagttccttacctccctggtccccgtttgtcaaagaggatggactaaatgatctctgaaagtgttgaagcgcggacccttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccaatgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtatggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccaccttagccccttcaaaaaagtgct

SEQ ID NO: 32411 - DNA, 2738 bp, Homo sapiens
aagacgcagtcttcagcaaggaagtgctgggaacgccctggagtgaacccaggaagatgcctgcagtgggtgccagggcccctctccaccgtccctgctgggcttcggggccacgcccgactgctgtgaacggcctgcggagcaccacgtgcgacggctggaggcgagaggtctgcctttgatgtggctgttggtgcagggcctgtggtgccttccgcagcggaaatggcgcgccgcccggggagggcgggagcagcgtcccgggtgcccctgtgaggatgagcgacgagatgactggagggtccctgaagacctcactagggtgcccccagccggtccgctcccaggaagcgacacccccacagccccagggctgcagctgagggggtcgccactctggctgggcgaggctgggcccttgggggcaggcgccagagtggcctcaggctctacaagatgcctgaaaacaccaacctctccagggctcactagcattggacgctttcacgctctgccctggccggaagccccctcaccccgcgcgatgtgcaaactcctgcagggctcactcagtttccagaactttaattattggaaagttctccctggtccagcccccaaatctgccgtgaacgttgacagctgagttgctgctccatgcgtgctttggctgagagcagaggggacccctgtcctccctgagctgctgacgaggggaggggtgaagggtggggcctctggagagggcaggtcccggggaagctccggactcctagaggggcggccaggtgggggccctggtgaccaggacagactgtggtgttttttaacgtaaaggagatccgcggtgtgagggaccccctgggtcctgcacgccgcctggtggcaggccgggccatggtgggtgctcacgcccccggcatgtggccgccctcagtgggaggggctctgagaacgactttttaaaacgcagagaaaagctccattcttcccaggacctcagcgcagccctggcccaggaaggcaggagacagaggccaggacggtccagaggtgtcgaaatgtcctggggacctgagcagcagccaccagggaagaggcagggagggagctgaggaccaggcttggttgtgagaatccctgagcccaggcggtagatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctgctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtatggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccaccttagccccttcaaaaaagtgct

SEQ ID NO: 32412 - DNA, 1038 bp, Homo sapiens
acccacgcgtcgcggacgcgtgggcgaaccacgcgtccggcggacgcgtagggtcctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctggtgagcgcggtgcacgcggctttaagtgtgctgggcagagggaggtggtgatattgtgtggtctggttcctgtgtgaccctgggcagttccttacctccctggtccccgtttgtcaaagaggatggactaaatgatctctgaaagtgttgaagcgcggacccttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccaatgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtatggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccaccttagccccttcaaaaaagtgct

SEQ ID NO: 32413 - DNA, 351 bp, Homo sapiens
tggctgggactttccagagactagatacccttcactcttagggttgaagaaaatcagtttaaaagtggaaaaatgatgagaaattataaatgctgccgcataagggctcaataagtgattacgtaaatttgaattttcccaacacgttcctttgcaaacacataaacatcagtatttgcttcctgtcttcgaagattatatttcttcatggcagggtttcaaaatgttacataattgggggactggtggaactgaagaggggaaagagccagaaaacgtgttcaggcttcagctccaccttttctactcttgcgtctgttgacaagttaataaacccttttcagactttta

SEQ ID NO: 32414 - DNA, 2625 bp, Homo sapiens
gtgttcaatatggactttattcaactctcgactatacaatgaatgactgagattcagccactacgtactaccctaacatactcataacagttaatccacataaggtgtatgatgacaatagcataacagataatcaagatgagaattcaaaaaaaactgatcaaaattacgaggtatcaggggtaggttttctaggaagaccatcactgaaagatgtaagataaaagctgaccctcatgtttctctgttgccactaaaggtgggcaagaattggacaaaactgccagtgttttatgttggatagaaagaagacatagagttgtagcatctctgttccaaggaataatgaaccagagagatttacagtacagtgagatctgaagtcaagaggatggaaaatatagcctttcaagaatttttttccagtcgttggtcctctaagtgaccaggcctccttcttaaagttctttagtcttgttctaggatgacatcacagttaggcattttatgtcatgccctacatgtatatacggtagtcctcccttatttctgggggatacattccaagacccccagtggatgcctaaaaactctgatagtaccaaaccctatatatactatgtttttttttctatacttacatatctatgataaaatttaatttgtaaattaggcacagcactcttgccctttggggctattattaattaaataggggtacttgaacacaagcactgcgatacagtcatctgataaccgagacagtcgatctgatcaccgagactgctactaagtgactaatgggtgagcagcatgaatatgctggacagagggaggatcacctccagggcagcaaggggcaagatctcatcatgctcctcagaatgctgtgcaattaaaatttatgaattgtttatttctggaatgttccatcaaatatttttggactgctgttgagcgtaactgaaaccatgaaaatgaagccatgggtaagaggggactactgtataccatttctttttttagtctccctgctactctccactaggagaataaaggtgggagaacaaaggggtctggcaggaaggagattgcaaactatgttgtcaattcttgaaacgaatccatgagccctgtgcggaaaccctctaggtctgttcctctcaggacattaaatcattctctttttatttctaatatagtcccatgaatttatttcctaagaaactttagaaagtttacagctttttaactatatgtccatccactatttgacatcctgggggtcatcggcccacccaggagctttcatgatcaagtcaaaatcacaatgtatccattgggcttcagggcagaacatgcgtcctcagatgattgttgtacacagaaaattagggaacacagctaagatcaataccagggagctcccaaatgggaattccattttcattccttcattaaaatcataaaatccataataattcctggttagcaataaacacaaccattgtgccacatcataaatcacaccttctgatcgacagaaaatgagaatgataatattataaaataaaataacaatgataataatgccataacttaagatctttcatgtagtccagctacagaatttttacaaaatggaataaattaatgcaaacaatactgctctttgtataaattaaacattttccttcatcctaagagctataaatcacagacactacattttaaatcaatgtatcaacataaagtgtaaacaaatggatcaaacaagcaaaaggaactctaaattccctcctgcctttcctttttggctgatgcaatcagtaaaacccagaggagcggcaacattttcatgtgcattggaaatggtttaacagctgtctgtgcaagtatttcctaacgtccaacatgatgcagtgtcaaagagtccagtgaatctagagaggttgtttgacggtaatctgtcttggagacagggacaggtactaggtcaacacctatttgtacataaaattctaaaaaaatttttccttaaggccaaggcaccatgaagtaccttggaatgcttttcagagcccatgaccctggagacaggcaggacctcatgcttttggcaatgtaaaaatccttcctatccctgctcagcatcccttgttctttccacaaatgttcaaatccagttatttaaaactgcattgatttggagtgaagtaaaagatattttacaagtagcattgaacaaaaatgctattgtgctgggagaggagttgccttttgcaagctgcttgtttttgcttttattctgacagtggtagccagtcattaagacttctaagataggccgggcacagtggctgatgcctgtaatcccagcactttgggaggctgaggcaggcggatcacctgaggtcaggagtttgagacaagcctggccaacatggtgaaaccccgtgtctactaaaaatacaaaattagccagacgtggttgcgggcgcctgtaatcccagctactcgggaggctgaggcaggagaatcgcttgaacctgggagatggaggttgcagtgaactgagattgtgccattgcactctagcctgggcagaaagagcaaaactctgtc

SEQ ID NO: 32415 - DNA, 771 bp, Homo sapiens
gtgattgaaggattgtgatgacaatctctttgcagcagctatgtatggtttatgtgaagtatccccacttattcttgtggagcaggtttggtgagacagcagtaaccaaatgacatgccaatattactggtgcaactggtattctacaaatgcataaggaacacatagacgacttccttttaggataaaatgatgcttctttcactaccttttgtggtagctgtggcttccaatagcaactgtttgacagttatataaatcttgcatgtgtattcttagtttgtgtcccttaagtactacttaattctcaagtagtaatgttattcttatacccttcagcgttctattttgattcaaaacaattgattcaaaacaattttgaatcaattttctattttgattcaaaacaattgataattctgtaaaaaaacataaacactgaattcttcagtgaaccaaagcaacaaataatagagaaaacttcttgaaactggagtgtgggaaaacttcttaacagaactaagagttaaaggtagtgagaagtgtgtggtgtgtgaattctttagtggtaaggggaaatgtgggctaaatccttttctttcatgaaactctcattctattttatatttctggtttgttcttgttcccatgtgagaaaacatacagtttctgaaaattcaaaatggtcatcaatgctttggactttacataattatgtattagagaaggtgcaactgtacattacttaatatactatgaacataatagaat

SEQ ID NO: 32416 - DNA, 327 bp, Homo sapiens
tttggtagaaattgagatgttggttctaaaatgaaataaaatgcagaggacctagaatatataatttccctttaatttgacaaagaagaaaaacatgttgggaagctcacctaatttcagtgtaatatttacatacgaatcaacaaatggatcagtggtatagaatagagaatcctgaaatagatctacatatatatggccaacagatttttaataatggtgccaagtctattcaggggaaagaaaattcttttttaaaaatgggattggaaaaactggataagggaaataagtgaacctcgacccctaccttataccgtgctcaaa

SEQ ID NO: 32417 - DNA, 408 bp, Homo sapiens
tttgttttgagacagagtcttgctctgtcgcccaggctggagtagtgcagaggtgcgatcttggctcactgcaacctctgcctcccagtttcaagtgattctccgacttcagcctcctgattagctgggaccacaggcacgcgccaccaagccccgctaatttttgtagtttcagtaaagacgggttttcaccatgttggccaggctcatcttgaactcctgccctcaagtgatccacctgcctcggcctcccaaagtgctgggattacagacatgagccaccacacctggccaagattatttttaatgttaattttttagagtagtgatgagagttctgtgttaaagttagtgttctaggaagactcttctccttataaacactttcttaggacagatacacttttt

SEQ ID NO: 32418 - DNA, 312 bp, Homo sapiens
ccaatgtatgaatcctatgagattatcatccagtttcagagcaggggcaggaattgtttgggggagtaaaaatacatggattaaatgcctagctcttggtcagtatggtacatatatttccaagctttgtttggtgagagagcttgaaattaatgacaacccagtagcaatgagcacacctaggactcatatcttggtatttaaatatcagttcttcaaatgctctttgaagtagctgatttcaaatctggggtagctatagtacaagatgagcctggagcaactttggcactaaaaagttagaaagtcctc

SEQ ID NO: 32419 - DNA, 575 bp, Homo sapiens
cttgtgtgctcatatgttgactgatggctgtcagcccctaggtagcttcaggacggggctgggcaccagaaggacacagcgggattggagggttcggactttctcctacgtgtgttcagggaaactaagtagcatggcagcagcccagagcccccgggtcagtggctacacagcagcagtgagcagcctcctgggaggagcgaagggctgaaggttaagttggccaatgatttagtcattccttcctgtgtgatgaagcctccataaaaacaccaaaggggtgggcgtggtggttcatccctgtcttcccagtactttgggaggctgaggagggtggatcacgaggtcaggagctcgagaccaacttgaccaacgtgatgaaaccctgtctctcctaagaatgcaaaaattagccaggcatggtggcgtgaacctgtgatcccagctactcgggaggctgaggcaggagaattgcttgaaccctggaggcagaggttgcaatgagccaaggttgcgcccttgcaccccagcctgggcaacagagtgacactctgtctcagaaaaaacaaaacaaa

SEQ ID NO: 32420 - DNA, 456 bp, Homo sapiens
ctgggcactcgtcagggtctgccctggagagctgacgcaagaggcacatttgcccctgaggaaggctgtgtgtcaggagtgaagaggggcgtgcaggcaacccctcctcaccccaggtgcatggaagccatcctggtacccacctctgggatggaggtaggacaattaattacatgttctgtctttgggtagaaatgctactgagccataggggctggatcaccactgctgcccagtatggcccaccagaccaccttccaccatcctgcaaagccctgcagaattgccagtgcgccctgcagtttttgtgaccaccagcccagtcccattcgattttcatagcccttgagtgacagcccatctgggacaagactcaaatgattgtcacatcttttcttctaactctttagccagctgggggatttaaaaataatgaattggaaccgttcgtggtat

SEQ ID NO: 32421 - DNA, 368 bp, Homo sapiens
acggtcggtttatttttttcaattttcaattagtttttgacaagttaataaaacagaaaaatgaaaagacatacaaagtccaagtcaaaactttttatcgttagagttaacagccataaaattacctgcaaaattgacatagagttttctactctctctctgtgaaccatttgcaaacagttctcagaagagcccaggtctatagaccatggttagagtactcaaggtaaactactcaaattagaccatactcagctgtagagtttcaaccaaatgagatttgtttggagaacatcatagtctctctcagttgggcgtgctggctcatgactgtaatcccagcactttgagaggccgagtcggtagat

SEQ ID NO: 32422 - DNA, 505 bp, Homo sapiens
cttttaaacaaatgagaatttacaagatgtgtgactttctaactctatcatacgtcggcaacctctttccatctagaagggctagatgtgacaaatgttttctattaaaaggttggggtggagttgagagcagctttttcatattatatacacaggccttccgtaaacggcctgtgaatcttcccagaggatggagggcatttccaacgggccaaacgtggcctgtcattctaccatttgtctcttccgacagcaaggtctggtagtacggagaccaaccgcccgatcgccgctaaccgttccacccgtcgtcgttcgggacttcgctcacctcccaggcccgttaaggcctttgtccgttgtcgttaggactaggtaggtctcgcccaatggcgacagagtggtcacccgggacccagatctggcggctccgtggcctgaagaggcggccgagcctgcctgcgtccctaggccgccttcccgggccctccatgccctaacgccc

SEQ ID NO: 32423 - DNA, 362 bp, Homo sapiens
acaccactgctgtcaagcccaaatgacagaccaagaccctgtctccaaaggaaaaaaaagaagagttgggagtggaactgtacatggttaataaccctggactttgctctttgtggaagcattggccttcaggaatttggtgagactcccaaatgtatcagtgcagttagtctccctaagggatggttgttaggtgcttcctatgccatttgatgctgaggaagactaattctgtgtttttgttttgttttttgtttttcttctgagacggagtttcgctcttgttgcccaggctggaatgcagtggcacgatttcaggtcaatggcacaatctcggctcagtgcaacctctgcctcctggg

SEQ ID NO: 32424 - DNA, 447 bp, Homo sapiens
cggccgccacttggaagggacccacctacagtggcggaagtggagtaagacatcatgttgcctcaagtttaattggaaatcgcgtgccttgtgaagaatggacactcagtagatgcttattgatgaacctgttggttgaggataactcgctaacttttctgagctttgttggaaaaactagcaagtgtgtatcattggccccaagcaccttctgtctgttgacctggctcaaacttcaatctgaccatcagtgaagaaggctgatgccgcagatggagagagacacaggatgtatgaatgtagcataactcaggattcacctcgtgtggtccttcccacttgaaccctatcctaagtgtgaaagttaccccatcgctttcctcttgcttcagattatgtgctttaaagtgatttaataaactatgcgattcaaacatcttaatttga

SEQ ID NO: 32425 - DNA, 433 bp, Homo sapiens
aaagggatggaaagaaccagccacttataccagccacttatggtcctactctgggcccacatgtgctctacctaagaaatccttatagtacccatagctttttgcaggctgattgacaagttatggctgtggccaggcgtacttgtcactgtctctctttaatagagcaagtgtgtatcattggccccaagcaccttctgtctgttgacctggctcaaacttcaatctgaccatcagtgaagaaggctgatgccgcagatggagagagacacaggatgtatgaatgtagcataactcaggattcacctcgtgtggtccttcccacttgaaccctatcctaagtgtgaaagttaccccatcgctttcctcttgcttcagattatgtgctttaaagtgatttaataaactatgcgattcaaacatcttaatttga

SEQ ID NO: 32426 - DNA, 889 bp, Homo sapiens
cggcacgagggttgcgccacaggggtctccagggccctcgcaggttggggtggtctgagctagtctgaaggaggacagtcagctgacttctcctttatctctctttcccaggatagcaggttcccttggtgtattacagtttctgaagtgttgattcccttttcaattgattccacagatgacagtcctgacgtttaaaaaattgccagataacctttaattttttttttttttaacagaacacaaacttaagccagattgcctaggattgaaccttggcctctcacttcctagacgagtggccttggctagttaaccaccttcgtgagcctcagttttgtcatctgtaaaatgggagtcataagtgtctacctcacagagctgtgattgaaaggataaatagcaccttgcacatagcggtgtagaagtgcttgttattgttaatattttatttaccttcacgcagcctacagtggcggaagtggagtaagacatcatgttgcctcaagtttaattggaaatcgcgtgccttgtgaagaatggacactcagtagatgcttattgatgaacctgttggttgaggataactcgctaacttttctgagctttgttggaaaaactagcaagtgtgtatcattggccccaagcaccttctgtctgttgacctggctcaaacttcaatctgaccatcagtgaagaaggctgatgccgcagatggagagagacacaggatgtatgaatgtagcataactcaggattcacctcgtgtggtccttcccacttgaaccctatcctaagtgtgaaagttaccccatcgctttcctcttgcttcagattatgtgctttaaagtgatttaataaactatgcgattcaaacatcttaatttga

SEQ ID NO: 32427 - DNA, 364 bp, Homo sapiens
tctttaatttgccagacagagaacttgagaatcaaccctatttctttacagttaaaaataaaaataacatgtggctatatgaggtatgctagcatatcaaagattgctgagaattagatgatcataggaaagaaccatagaatttaacttctagtatataagttactattaatgaaaatagtatttaaaactggaaaaactgaacataaatgcttaagaaggaaattgatgtttaggaaaggtaaaggccaggcacagtggttcacgcttgtaatcccagcacttttggaggttgaggcaggaggatagatggagcccaggagtttgagaccagcctgggtagcatagcaagacatcatctcta

SEQ ID NO: 32428 - DNA, 221 bp, Homo sapiens
ttgtatttgctataggtttttttctttgtggttaccatgatgttagcataacatttcttgtagttctaatagcctatttgagctgatagcctcaattgcataaagaaaaccctctatacttttacttccttctcaacactatattattgatgtcagaacttgcttcttttacactatgtatctattaaccaatttttgtggttatagttatcttttatact

SEQ ID NO: 32429 - DNA, 547 bp, Homo sapiens
cgaccctgtcatggaggaacctctctctgcctcccgcctggaagatcccttgggtccttgatctccgcaggagctaagttgggcctgaaggtcaggagggtttggtaacaaggccctgcagccaggaggctggatcactgacaagtgaccctgggcaaggtcactcttgacaagggctctcccctctccagacctcagtttcctcgtctgtcatcaagggggtgctgggttagtgctgcttggagtcaggccccccccaagaatctaataaaagctgccgaccttcctcctgtaaaacagttatgcacccacattccttgtgaatgtctgtgggaggttcagggaccctccccaaccagagcctccaccctcccctgcccctcggctagatgctctccagcatcactccagccctcagtgaggacccggcgctgagggaggaggaaatcacaacagaaaagtggctgcggtgctcatggctcctcagcatcatccagggccccccacagaccaggtagtttaggagctttacatggacgaaccactt

SEQ ID NO: 32430 - DNA, 248 bp, Homo sapiens
cctctcccccgtcccgcgcgcccccccggcccatttcgggccttcatgacagggccagagccagccagctttgaagacgcggccctgccccgacacaggcagcctggagaagctgggcaggacaagtaggacatccctgagaagacgacagaagggactggcctctgcccacaccttgacttcagtatttctgacctcctaaactctaataaagtcatgcttacagccactaaaaaaatgcagaagag

SEQ ID NO: 32431 - DNA, 2051 bp, Homo sapiens
ttccgcagcatggacaccatcgtgggcatgctccacaaccgctccgagacgcccacctttgccaaggtccagcggggcgtccaggacatgatgcgtaggcgttttgaggagcgcaatgttggccagatcaaaaccgtgtacccggcctcctaccgcttccgccaggagcgcagtgtccccaccttcaaggatggcaccaggaggtcagattaccagctcaccatcgagccactgctggagcaggaggctgacggagcagccccccagctcacggcctcgcgcctcctgcagcgacggcagatcttcagccagaagctggtggagcatgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggggaaatggagaagcacctgctgctcctctccgagctgctgccggactggctcagcctccaccgcatccgcaccgacacctacgtcaagctggacaaggccgcggacctcgcccacatcactgcacgcctggcccaccagacacgtgctgaggaggggctgtgagcctgggggccactgtggacagacgtgggcttcagaagctcgctggcctgggcccaccagcattttcttttatgaacatgatacactttggccttcctttccccagcgcccctgagggccagaggcagatgtgggctgcaggctgcacagcccgagggtctctggctgcgggcggtgggccccttcatggggctcacctggtggattcacattaaaccggtttctgtgggcacctctgtccttgctgctggtggggaagggaagccagatccagcaccccctggggggccatcgggagtgtggctgggggtgaagggggctctgtggcaatatggggttgggtagtgtgggtggcaggccatcccctctaatcttggaacctctgaatatgggacctcccacagcaaagggtgacttttgtcattaagaaagactggggtgggtgtggtggctcacgcctgtaaccccagcactttgggaggccaaggtgggcagatcacgaggtcaagagatcgagaccatcctggcgaacatggtgaaaccccatctctactaaaaatacaaaaaattagccgggtgtggtggtgggcacctgtcgtcccagctactagggaggctgaggcaggagaatggtgtgaacccaggaggcacagcttgcagtgagcgaagatcgcaccactgcacgcactccagcctgggtgacagagcgagactccgtctcaaaaaaaaaaatttcaagactggagaggtgatcctgaattgtccagctacgccccatgtcatcacagggccttcatgacagggccagagccagccagctttgaagacgcggccctgccccgacacaggcagcctggagaagctgggcaggacaagtaggacatccctgagaagacgacagaagggactggcctctgcccacaccttgacttcagtatttctgacctcctaaactctaataaagtcatgcttacagccactaaaaaaatgcagaagag

SEQ ID NO: 32432 - DNA, 1543 bp, Homo sapiens
ttccgcagcatggacaccatcgtgggcatgctccacaaccgctccgagacgcccacctttgccaaggtccagcggggcgtccaggacatgatgcgtaggcgttttgaggagcgcaatgttggccagatcaaaaccgtgtacccggcctcctaccgcttccgccaggagcgcagtgtccccaccttcaaggatggcaccaggaggtcagattaccagctcaccatcgagccactgctggagcaggaggctgacggagcagccccccagctcacggcctcgcgcctcctgcagcgacggcagatcttcagccagaagctggtggagcatgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggggaaatggagaagcacctgctgctcctctccgagctgctgccggactggctcagcctccaccgcatccgcaccgacacctacgtcaagctggacaaggccgcggacctcgcccacatcactgcacgcctggcccaccagacacgtgctgaggaggggctgtgagcctgggggccactgtggacagacgtgggcttcagaagctcgctggcctgggcccaccagcattttcttttatgaacatgatacactttggccttcctttccccagcgcccctgagggccagaggcagatgtgggctgcaggctgcacagcccgagggtctctggctgcgggcggtgggccccttcatggggctcacctggtggattcacattaaaccggtttctgtgggcaaaaaaaaaaaaaaaaaaaaaaaaaaaaaaaaaaaaaaaaaaaccggggggacttttgggggggggggaaaaaggggtgtataagaaagggggacatgggggacaataaggttgttctcatggagcccagagtttttctgtcgcaacaaggggggggaaaaattcggggggggtcctccatatatagaggaggagggcggatataattttcggaataaagacaggggtaaccggggttttatgagactcggagaagtgt

SEQ ID NO: 32433 - DNA, 2015 bp, Homo sapiens
ttccgcagcatggacaccatcgtgggcatgctccacaaccgctccgagacgcccacctttgccaaggtccagcggggcgtccaggacatgatgcgtaggcgttttgaggagcgcaatgttggccagatcaaaaccgtgtacccggcctcctaccgcttccgccaggagcgcagtgtccccaccttcaaggatggcaccaggaggtcagattaccagctcaccatcgagccactgctggagcaggaggctgacggagcagccccccagctcacggcctcgcgcctcctgcagcgacggcagatcttcagccagaagctggtggagcatgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggagatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggggaaatggagaagcacctgctgctcctctccgagctgctgccggactggctcagcctccaccgcatccgcaccgacacctacgtcaagctggacaaggccgcggacctcgcccacatcactgcacgcctggcccaccagacacgtgctgaggaggggctgtgagcctgggggccactgtggacagacgtgggcttcagaagctcgctggcctgggcccaccagcattttcttttatgaacatgatacactttggccttcctttccccagcgcccctgagggccagaggcagatgtgggctgcaggctgcacagcccgagggtctctggctgcgggcggtgggccccttcatggggctcacctggtggattcacattaaaccggtttctgtgggcacctctgtccttgctgctggtggggaagggaagccagatccagcaccccctggggggccatcgggagtgtggctgggggtgaagggggctctgtggcaatatggggttgggtagtgtgggtggcaggccatcccctctaatcttggaacctctgaatatgggacctcccacagcaaagggtgacttttgtcattaagaaagactggggtgggtgtggtggctcacgcctgtaaccccagcactttgggaggccaaggtgggcagatcacgaggtcaagagatcgagaccatcctggcgaacatggtgaaaccccatctctactaaaaatacaaaaaattagccgggtgtggtggtgggcacctgtcgtcccagctactagggaggctgaggcaggagaatggtgtgaacccaggaggcacagcttgcagtgagcgaagatcgcaccactgcacgcactccagcctgggtgacagagcgagactccgtctcaaaaaaaaaaatttcaagactggagaggtgatcctgaattgtccagctacgccccatgtcatcacagggccttcatgacagggccagagccagccagctttgaagacgcggccctgccccgacacaggcagcctggagaagctgggcaggacaagtaggacatccctgagaagacgacagaagggactggcctctgcccacaccttgacttcagtatttctgacctcctaaactctaataaagtcatgcttacagccactaaaaaaatgcagaagag

SEQ ID NO: 32434 - DNA, 379 bp, Homo sapiens
cttctacctggaatgttctccacattccctcctttccagctgccacctgctttctctagctaacacctactcaaacgtaaaggttcagttcagatgttactacctccataaaacccttggattctctcatcccttttccccttccctgtctggcctggcacagggccccatctgcatgctaccctagcaccaaggcatatacctaccacaacattaggctacaagacagtgaacccaactgtttcacccatcagttctcccctgaaaggtactaatggaaatttcacatcggctagggccatgttccttgtgtcagtaggcctaagggcttaggcacaaggcaggacctgggggtacagagtaggaactcagtaagggc

SEQ ID NO: 32435 - DNA, 381 bp, Homo sapiens
attgaaaacttcctgaggcctcctcagaagcagatgctgctatgcttcccgtacagcctgaagaaccaaacatttctatacatttatgagacccaactccaaaagcatactggaatggaattaaagaccgaactacagaagctaaagagagctgatcaaactaaaaaaaaaagttaaaggtgaggaggccaaggctcagaagagtcacttgcccatgatcactgctcttatagcgccaactcagagctcaggcaatgctcatgttctttccactgtgcctcatcgctcatgtctgactcttctagaaatgtgggcaaatcccctgccttctgtgggtctcagatttccataaaaaataaaatcaatggatcaacttaatta

SEQ ID NO: 32436 - DNA, 795 bp, Homo sapiens
ggcacaatcagagctcactgtaaccttgaactcctgggctcaggcaagcctcctgcctcagccttccgagtagctgggactataggcccacgccaccatgcccagctttttaaaatattttgtagagacgaggtctctctctgttgcccaggctagtcttgaactcctggcttcaagcaatcctcctgctttggcctcccaaagtgctaggattacaggcatgagccactgctcctggccttttttttaataaggcaatcctaagtagcctcaggctgctgaggttgagtctcttcaacccagaagggcttggctgggattggccaaaaggcctcccagagaatcccaaaccattagagtctaacttcccaaatgtgaccggcaggcactgcatgctcaggtcccacccactgcctctccccacactcttcacctctgtgctgcagccacgccaatttttcagttcctccaacactgtcaggcaggccaggcaccctcccatccctaagctttgcacatttggaactccaagaggggaggactgttttgttcctctctggatgtccagaacaagaactacctggcacatattaggtgctccataaatatatgttgaatgcctcttcctttcttccgtgaacactcttcctcctcccctcaacggccactgtgtacttcagcccaaagtttaaacttcgtttcttcagagaagttgacaccctaaatagtgcaggtcccctcaaatgtgtccttaagctatcctccactgcttcctgcccttcaccccagctatga

SEQ ID NO: 32437 - DNA, 211 bp, Homo sapiens
aaggtgactcggggctgaggacaggatggtctggagtccagtttggagacaaattctagaaaataaggcgatgccatcatgaggatgctgcacactctccaggcccagcccttgagcacgggccccgcccgccctgtctgcgggccgactccgcgacgccgaccggctcgcgcctccgcccccgagcgccccggcgggcggagttgcgggt

SEQ ID NO: 32438 - DNA, 1726 bp, Homo sapiens
tgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaa

SEQ ID NO: 32439 - DNA, 1594 bp, Homo sapiens
tgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaa

SEQ ID NO: 32440 - DNA, 1854 bp, Homo sapiens
tgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaa

SEQ ID NO: 32441 - DNA, 3087 bp, Homo sapiens
  misc_feature (1326)..(1326): n is a, c, g, or t
  misc_feature (1430)..(1430): n is a, c, g, or t
  misc_feature (1460)..(1460): n is a, c, g, or t
  misc_feature (1809)..(1809): n is a, c, g, or t
  misc_feature (2290)..(2290): n is a, c, g, or t
  misc_feature (2585)..(2585): n is a, c, g, or t
tgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttggtgagttcctgcacatcaagggtccttgggcctgagatggtctctgtgtgatgtgactttacttgagttaccaaccctgcctgagcctcagtttcctcccctgtgaaatgagaacacggggtaactgcgatcattgcacttggtgttcacagtgggccaggcacacagtagacactcagttcaaccaatccgctgccttctgttctgagctctaaagctgctaattctcccagtctggaagagatggagccaggactcctgggttctcctggggatcagggagagtcttgggaagtagggagaggaatggtctctccccattccaagcggtccacccaacatggacagtcaaggaagggccctgattttcaagggcttgaaggctgggcagatatgggaatatggacaacctaatctgagcccagccctgaccagcctcccccaacagaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcaggtacacntggtgggggtcctcgtcctggcctggggcatggcttctggccaactggggaggaggtgctcagagaggattttgcagaagaggggctttgctctatttggaaanatgggaagagaaggatatgaatgaaggggncccaggtacccttcaagcaaatacaaaccagatctgaacacatgtgaatatttgggggaaacgtcaaatgtaagcaaaccaccacagcatgctgcaggtgtttaacggccagctctccggagagaaaattcctgatgtgttgtgtttgccaatttccccagtgtaaatatttccactgcggctgatttcaagctgtgatgtgctgtcactcagtgcagagctgaaaggagatgtgctggaccagcaattagtagtgggtccaatgtggctccagtacatgaaacccagtcaggagtaaattcatgtggacatgcaaaatagataaacatgcagcattcacaggagcacntgaggagaggccagctgtgcatgcgtgcctgcatgtcaggacacacatgccatggggatacagatgtgagaggggctcagacatgaggaggctcaggacctgctatatcagaaaactgcaggttaacttgaaagcagaactttctgccaagagacggggaggtggaacctggaaaatgggaagcagagctccctcctgactcctcctctaccctccagaacttcctacagctgcagacttccaggagtaaccgcttctcctggatgggactttcagacctaaatcaggaaggcacgtggcaatgggtggacggctcacctctgtcacccaggtagattctgggagaaagggacactgtatccagtcgggctgggttcctgcaactctgacttgagctttccctgggggtcccccccaacctccctgaccccataggactaagagtctggggttttactgagttgaggaaggtggtcttcanacccacctccagacaggatgaaaggtgccaagaattccaccagcagagctgcaggaggagcttgccctgtgggtaggtgtgttaaaatacagtgtattaataggaagtctgaagtctagtaaggccaccagctcaggagacaattgccatttacacaaagtgagtagcttatcctacccacaggttcctagagggcgcacatttcacagcagggggccgctggggaagcagcagggtctgtcgtgagggaaagtcatggaggggactgtgggccagagcttttattatggtttgnatggggagaaaagggcaaggccaggcaagcaggcttcagatgggcagatatgaagcattttgtgggctctggggcatagaggctgcctagcggcctgacacctggccttggggtgattagggcagaaagatagtggcttggagtgcaagagcccaataaggcaggtggttggcagtacagaccccagactggttggtttgtattttaaaatcacactctcggccaggcgcggtggctcacgcctgtaattccgtcactttgggaggtcaaggcgggtagatcacgaggtcaagagatcaaaaccatgctggccaacacggtgaaaccccgtctttactacaaatacaaaaattagctgggtgtggtggcgtgcacctgtagtcccagctactcaggaggctgaggcaggagaatcacttgagcccaggaggcagaggttgcagtgagccgccaagatcatgccactgcactccagcctggcaacagagcgagaatccgtctc

SEQ ID NO: 32442 - DNA, 2371 bp, Homo sapiens
tgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttggtgagttcctgcacatcaagggtccttgggcctgagatggtctctgtgtgatgtgactttacttgagttaccaaccctgcctgagcctcagtttcctcccctgtgaaatgagaacacggggtaactgcgatcattgcacttggtgttcacagtgggccaggcacacagtagacactcagttcaaccaatccgctgccttctgttctgagctctaaagctgctaattctcccagtctggaagagatggagccaggactcctgggttctcctggggatcagggagagtcttgggaagtagggagaggaatggtctctccccattccaagcggtccacccaacatggacagtcaaggaagggccctgattttcaagggcttgaaggctgggcagatatgggaatatggacaacctaatctgagcccagccctgaccagcctcccccaacagaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaa

SEQ ID NO: 32443 - DNA, 2258 bp, Homo sapiens
tgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttggtgagttcctgcacatcaagggtccttgggcctgagatggtctctgtgtgatgtgactttacttgagttaccaaccctgcctgagcctcagtttcctcccctgtgaaatgagaacacggggtaactgcgatcattgcacttggtgttcacagtgggccaggcacacagtagacactcagttcaaccaatccgctgccttctgttctgagctctaaagctgctaattctcccagtctggaagagatggagccaggactcctgggttctcctggggatcagggagagtcttgggaagtagggagaggaatggtctctccccattccaagcggtccacccaacatggacagtcaaggaagggccctgattttcaagggcttgaaggctgggcagatatgggaatatggacaacctaatctgagcccagccctgaccagcctcccccaacagaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaa

SEQ ID NO: 32444 - DNA, 2195 bp, Homo sapiens
tgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagttccttttcttcttggcccagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttggtgagttcctgcacatcaagggtccttgggcctgagatggtctctgtgtgatgtgactttacttgagttaccaaccctgcctgagcctcagtttcctcccctgtgaaatgagaacacggggtaactgcgatcattgcacttggtgttcacagtgggccaggcacacagtagacactcagttcaaccaatccgctgccttctgttctgagctctaaagctgctaattctcccagtctggaagagatggagccaggactcctgggttctcctggggatcagggagagtcttgggaagtagggagaggaatggtctctccccattccaagcggtccacccaacatggacagtcaaggaagggccctgattttcaagggcttgaaggctgggcagatatgggaatatggacaacctaatctgagcccagccctgaccagcctcccccaacagaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaa

SEQ ID NO: 32445 - DNA, 1722 bp, Homo sapiens
tgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagttccttttcttcttggcccagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtggaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaa

SEQ ID NO: 32446 - DNA, 1515 bp, Homo sapiens
tgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagttccttttcttcttggcccagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtggaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaa

SEQ ID NO: 32447 - DNA, 1534 bp, Homo sapiens
tgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtggaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaa

SEQ ID NO: 32448 - DNA, 2317 bp, Homo sapiens
tgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttggtgagttcctgcacatcaagggtccttgggcctgagatggtctctgtgtgatgtgactttacttgagttaccaaccctgcctgagcctcagtttcctcccctgtgaaatgagaacacggggtaactgcgatcattgcacttggtgttcacagtgggccaggcacacagtagacactcagttcaaccaatccgctgccttctgttctgagctctaaagctgctaattctcccagtctggaagagatggagccaggactcctgggttctcctggggatcagggagagtcttgggaagtagggagaggaatggtctctccccattccaagcggtccacccaacatggacagtcaaggaagggccctgattttcaagggcttgaaggctgggcagatatgggaatatggacaacctaatctgagcccagccctgaccagcctcccccaacagaacgcctgtgccgccactgtcccaaggactggacattcttccaaggaaactgttacttcatgtctaactcccagcggaactggcacgactccgtcaccgcctgccaggaagtgagggcccagctcgtcgtaatcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaa

SEQ ID NO: 32449 - DNA, 2317 bp, Homo sapiens
tgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttggtgagttcctgcacatcaagggtccttgggcctgagatggtctctgtgtgatgtgactttacttgagttaccaaccctgcctgagcctcagtttcctcccctgtgaaatgagaacacggggtaactgcgatcattgcacttggtgttcacagtgggccaggcacacagtagacactcagttcaaccaatccgctgccttctgttctgagctctaaagctgctaattctcccagtctggaagagatggagccaggactcctgggttctcctggggatcagggagagtcttgggaagtagggagaggaatggtctctccccattccaagcggtccacccaacatggacagtcaaggaagggccctgattttcaagggcttgaaggctgggcagatatgggaatatggacaacctaatctgagcccagccctgaccagcctcccccaacagaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcactccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaa

SEQ ID NO: 32450 - DNA, 1839 bp, Homo sapiens
tgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaa

SEQ ID NO: 32451 - DNA, 4947 bp, Homo sapiens
cccgggggggagagagccggcaggcggcggcggtggtggcgggggcgatgcgccgcgcccggccgcgctaggtgagccggcaccgggagcgcgggccgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctgggggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccaatagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctac

SEQ ID NO: 32452 - DNA, 301 bp, Homo sapiens
ggcgtggaagctgcgggtcggctgcgggaaagggggtcccatgggagccgctagcgcagcccgtttcccgagctgaggtggaggtcgacacgcacaggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttggtaagttggctaactgccc

SEQ ID NO: 32453 - DNA, 5090 bp, Homo sapiens
atcattagctattgagattatcagcactatcacctggacaagcagcggatgggccgccctcttggccaggtcttctgtgcgcactgacgttgtatgaaagttgtccccacatctcctacacccaccgacgccaggcggccgcgtctgggccagatatggatcacgcctgtggagcgcacctccacacaggcagccctcgtccaaggtgcagggcgcagggcacagggcacatgtctacggcccagtcctgcagacggctacctagagaccccagggcacaggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctgggggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccaatagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctac

SEQ ID NO: 32454 - DNA, 410 bp, Homo sapiens
atcatgccactgcactccagcctgggtgacatagtgggaccctgtctaaaaaaaaacaaaaagaaaaattaagtaaaagaatccttctataaaccagctctaagagaaggttgtagttcagtcttactgaagataaggcaaacccatctttattcctagatgacctgcaaagtaggtagctcttggaccttacctaccacacaaatgagctaacctggtctttcacaagactctctttaggctgaaattcatactatgtctcttcttgccttaagttttctttttatttttggtccagccacttaactgcctactataacagctgtcatggctttgttagatttgcaagtgaagataatggatcaatgtaatttcatacccgaaaacttggatattgttttgttttttga

SEQ ID NO: 32455 - DNA, 493 bp, Homo sapiens
cacaaagcgttgggtgagactcctcttgctcgtcatgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttgagcgtccctttctatcaacaaaaggccctttttagggcccccactttctcagctgaggagccgtgatgcttgtttgcccagtttctctttaccatttgttcgcgcctgctgagtttgtgctgctatcggagcatgcgtctctagtcgc

SEQ ID NO: 32456 - DNA, 1023 bp, Homo sapiens
aaaggtcggttggtttgcactggcggacaaatggtccaattaccgcggaaaagggacctctgaatccagattggcgtcctctctacctatagggtaggctcaggggcggtgagaaccagccccggatgtgggcgcggcactgaggtagaactgagagatcctctaccgcagtcgtttgaggaggcggaactgaagttttttcttaattatcatgtgacgggttctggatttaatggggggaaaagggcggaaaaggacaaggatccaaactggcgaatttgctgatcttcgcgtccctctccgctttccggccggcagcgctgccagggtatatttccttttttccgatcctgcaacagcctctttaaactgtttaaatgagaatgtccttggctcagagagtactactcacctggcttttcacactactcttcttgatcatgttggtgttgaaactggatgagaaagcaccttggaactggttcctcatattcattccagtctggatatttgatactatccttcttgtcctgctgattgtgaaaatggctgggcggtgtaagtctggctttgaccctcgacatggatcacacaatattaaaaaaaaagcctggtacctcattgcaatgttacttaaattagccttctgcctcgcactctgtgctaaactggaacagtttactaccatgaatctatcctatgtcttcattcctttatgggccttgctggctggggctttaacagaactcggatataatgtcttttttgtgagagactgacttctaagtacatcatctcctttctattgctgttcaacaagttaccattaaagtgttctgaatctgtcaagcttcaagaataccagagaactgagggaaaataccaaatgtagttttatactacttccataaaacaggattggtgaatcacggacttctagtcaacctacagcttaattattcagcatttgagttattgagatccttattatctctatgtaaataaagtttgttttggacctca

SEQ ID NO: 32457 - DNA, 411 bp, Homo sapiens
aaaggtcggttggtttgcactggcggacaaatggtccaattaccgcggaaaagggacctctgaatccagattggcgtcctctctacctatagggtaggctcaggggcggtgagaaccagccccggatgtgggcgcggcactgaggtagaactgagagatcctctaccgcagtcgtttgaggaggcggaactgaagttttttcttaattatcatgtgacgggttctggatttaatggggggaaaagggcggaaaaggacaaggatccaaactggcgaatttgctgatcttcgcgtccctctccgctttccggccggcagcgctgccaggtgagtctggggctctgccctagcccgcaccgtacgccggcgctggtctcctgatgcttccgtgggctgtgcggccgaccctca

SEQ ID NO: 32458 - DNA, 1261 bp, Homo sapiens
agaggcagggtttcactcttgccctggctggtctggagctcttgggctcaaatgatatgcctgccttctcctccccaaatactgggattactggcatgagccacgcacccttcccattcccttcttttaaaactctctctcttctcagcttgatacccacctttcactttttcactactttgaatgcttttttctttgtaccccttgaaattgaattaaaaattagatttgcaaatgtataggaagattaagaacatctttgaggtgcaggaataaagttgtaagtgcctggactcgagtgatagcactgaaaaggaatcacctgacattttgaatagagcttatacagtagatataataaaaattgtattttgtcatgggctgtaaggaatggtggatataatgtcaatgatcactaagttttagaggatttgaaaggaagaatagtagaatgttttcaaaattaggaagtcagttgggaaagaaccagttttgttcattaggaatggaagtgatactttttttctggtatcaaaacaatcttgactttttctccttctcttagggtatatttccttttttccgatcctgcaacagcctctttaaactgtttaaatgagaatgtccttggctcagagagtactactcacctggcttttcacactactcttcttgatcatgttggtgttgaaactggatgagaaagcaccttggaactggttcctcatattcattccagtctggatatttgatactatccttcttgtcctgctgattgtgaaaatggctgggcggtgtaagtctggctttgaccctcgacatggatcacacaatattaaaaaaaaagcctggtacctcattgcaatgttacttaaattagccttctgcctcgcactctgtgctaaactggaacagtttactaccatgaatctatcctatgtcttcattcctttatgggccttgctggctggggctttaacagaactcggatataatgtcttttttgtgagagactgacttctaagtacatcatctcctttctattgctgttcaacaagttaccattaaagtgttctgaatctgtcaagcttcaagaataccagagaactgagggaaaataccaaatgtagttttatactacttccataaaacaggattggtgaatcacggacttctagtcaacctacagcttaattattcagcatttgagttattgagatccttattatctctatgtaaataaagtttgttttggacctca

SEQ ID NO: 32459 - DNA, 1332 bp, Homo sapiens
aaaggtcggttggtttgcactggcggacaaatggtccaattaccgcggaaaagggacctctgaatccagattggcgtcctctctacctatagggtaggctcaggggcggtgagaaccagccccggatgtgggcgcggcactgaggtagaactgagagatcctctaccgcagtcgtttgaggaggcggaactgaagttttttcttaattatcatgtgacgggttctggatttaatggggggaaaagggcggaaaaggacaaggatccaaactggcgaatttgctgatcttcgcgtccctctccgctttccggccggcagcgctgccagggtatatttccttttttccgatcctgcaacagcctctttaaactgtttaaatgagaatgtccttggctcagagagtactactcacctggcttttcacactactcttcttgatcatgttggtgttgaaactggatgagaaagcaccttggaactggttcctcatattcattccagtctggatatttgatactatccttcttgtcctgctgattgtgaaaatggctgggcggtgtaagtctggctttgaccctcgacatggatcacacaatattaaaaaaaaagcctggtacctcattgcaatgttacttaaattagccttctgcctcgcactctgtgctaaactggaacagtttactaccatgaatctatcctatgtcttcattcctttatgggccttgctggctggggctttaacagaactcggatataatgtcttttttgtgagagactgacttctaagtacatcatctcctttctattgctgttcaacaagttaccattaaagtgttctgaatctgtcaagcttcaagaataccagagaactgagggaaaataccaaatgtagttttatactacttccataaaacaggattggtgaatcacggacttctagtcaacctacagcttaattattcagcatttgagttattgagatccttattatctctatgtaaataaagtttgttttggacctcaaaaaaaaaaaaaaaaaaaaaaaacaaaaagggaacaacaaaaaaaaccaaaaaaaacacaacgggggggggccaaggcggacacgagagaagacgagcaaagacaaacggagggggagagagggagccaacagggaaaggagcaaggggacaaaggggaacgtaggaacacacgggagcaacaaaaaggggggaagaaacaccaaataaaaagacgcagagggcaaacaggagagaagaaaggaaacacagtggggacagcgagggaaaaaaggggcatacacaaagggagccaaaggagggagaaata

SEQ ID NO: 32460 - DNA, 1207 bp, Homo sapiens
agaggcagggtttcactcttgccctggctggtctggagctcttgggctcaaatgatatgcctgccttctcctccccaaatactgggattactggcatgagccacgcacccttcccattcccttcttttaaaactctctctcttctcagcttgatacccacctttcactttttcactactttgaatgcttttttctttgtaccccttgaaattgaattaaaaattagatttgcaaatgtataggaagattaagaacatctttgaggtgcaggaataaagttgtaagtgcctggactcgagtgatagcactgaaaaggaatcacctgacattttgaatagagcttatacagtagatataataaaaattgtattttgtcatgggctgtaaggaatggtggatataatgtcaatgatcactaagttttagaggatttgaaaggaagaatagtagaatgttttcaaaattaggaagtcagttgggaaagaaccagttttgttcattaggaatggaagtgatactttttttctggtatcaaaacaatcttgactttttctccttctcttagggtatatttccttttttccgatcctgcaacagcctctttaaactgtttaaatgagaatgtccttggctcagagagtactactcacctggcttttcacactactcttcttgatcatgttggtgttgaaactggatgagaaagcaccttggaactggttcctcatattcattccagtctggatatttgatactatccttcttgtcctgctgattgtgaaaatggctgggcggtgtaagtctggctttgaccctcgacatggatcacacaatattaaaaactgtgctaaactggaacagtttactaccatgaatctatcctatgtcttcattcctttatgggccttgctggctggggctttaacagaactcggatataatgtcttttttgtgagagactgacttctaagtacatcatctcctttctattgctgttcaacaagttaccattaaagtgttctgaatctgtcaagcttcaagaataccagagaactgagggaaaataccaaatgtagttttatactacttccataaaacaggattggtgaatcacggacttctagtcaacctacagcttaattattcagcatttgagttattgagatccttattatctctatgtaaataaagtttgttttggacctca

SEQ ID NO: 32461 - DNA, 1052 bp, Homo sapiens
aaaggtcggttggtttgcactggcggacaaatggtccaattaccgcggaaaagggacctctgaatccagattggcgtcctctctacctatagggtaggctcaggggcggtgagaaccagccccggatgtgggcgcggcactgaggtagaactgagagatcctctaccgcagtcgtttgaggaggcggaactgaagttttttcttaattatcatgtgacgggttctggatttaatggggggaaaagggcggaaaaggacaaggatccaaactggcgaatttgctgatcttcgcgtccctctccgctttccggccggcagcgctgccagggtatatttccttttttccgatcctgcaacagcctctttaaactgtttaaatgagaatgtccttggctcagagagtactactcacctggcttttcacactactcttcttgatcatgttggtgttgaaactggatgagaaagcaccttggaactggttcctcatattcattccagtctggatatttgatactatccttcttgtcctgctgattgtgaaaatggctgggcggtgtaagtctggctttgaccctcgacatggatcacacaatattaaaaaaaaagcctggtacctcattgcaatgttacttaaattagccttctgcctcgcactctgtgctaaactggaacagtttactaccatgaatctatcctatgtcttcattcctttatgggccttgctggctggggctttaacagaactcggatataatgtcttttttgtgagagactgacttctaagtacatcatctcctttctattgctgttcaacaagttaccattaaagtgttctgaatctgtcaagcttcaagaataccagagaactgagggaaaataccaaatgtagttttatactacttccataaaacaggattggtgaatcacggacttctagtcaacctacagcttaattattcagcatttgagttattgagatccttattatctctatgtaaataaagtttgttttggacctcatttttctacatgaaaaaaaaaaaatctgt

SEQ ID NO: 32462 - DNA, 969 bp, Homo sapiens
aaaggtcggttggtttgcactggcggacaaatggtccaattaccgcggaaaagggacctctgaatccagattggcgtcctctctacctatagggtaggctcaggggcggtgagaaccagccccggatgtgggcgcggcactgaggtagaactgagagatcctctaccgcagtcgtttgaggaggcggaactgaagttttttcttaattatcatgtgacgggttctggatttaatggggggaaaagggcggaaaaggacaaggatccaaactggcgaatttgctgatcttcgcgtccctctccgctttccggccggcagcgctgccagggtatatttccttttttccgatcctgcaacagcctctttaaactgtttaaatgagaatgtccttggctcagagagtactactcacctggcttttcacactactcttcttgatcatgttggtgttgaaactggatgagaaagcaccttggaactggttcctcatattcattccagtctggatatttgatactatccttcttgtcctgctgattgtgaaaatggctgggcggtgtaagtctggctttgaccctcgacatggatcacacaatattaaaaactgtgctaaactggaacagtttactaccatgaatctatcctatgtcttcattcctttatgggccttgctggctggggctttaacagaactcggatataatgtcttttttgtgagagactgacttctaagtacatcatctcctttctattgctgttcaacaagttaccattaaagtgttctgaatctgtcaagcttcaagaataccagagaactgagggaaaataccaaatgtagttttatactacttccataaaacaggattggtgaatcacggacttctagtcaacctacagcttaattattcagcatttgagttattgagatccttattatctctatgtaaataaagtttgttttggacctca

SEQ ID NO: 32463 - DNA, 374 bp, Homo sapiens
atgtggctcccaagtctctgtgtctgcagggcacttaggtaccctgcgggggttcagatctccttacagcccagcctgggaaatatgcagtgtcacctccaccacaatccagccagctcggattcaagcaaagggcactcatgggaagatgaccactggccagtgtgtttcatcaggctggcatctttgaagaccagataccacaccgacctccagtgatccaaagtgctgggattacaggcatgataccacaccacagtcatttgaatttgtcattacttggtactcttatttttttccctgctgctctttttgcattgaagtccttttgggatgacgtcaataaaactctttcatgtttttaagattgtatt

SEQ ID NO: 32464 - DNA, 842 bp, Homo sapiens
gccaccacatctggttaatttttgtatttttagtagagacagggtttcaccatgttggccaggctggtcttgaactcctggcctcaagtgatccacctgccttggcctcctaaagtgctgggattataggcatgagcctctgtctacggaatcttgtagcctacaaaatcttctggcctctgtctgcagaatcttgtctgtaccccgtgctagcctctcctctgacccactgggagtgttaagtccattcttctggacttttgctccagctgtgatgaacactatgcttctacctcagtcctgagcctggacccagctgtgcaagcctggccagacccctctcccagggctgaacaccaatttcaagtcttcaggtcctactgcaatctaaacaggctatccagaagagaatcctgcaccagtccaagtgtgagcaggcctggagactctgctgctgaactgcaccccctgatggccagcctggatgtcacttctatcctgcttgagccaggctccccggatccctggaccacctccactccagaccagacaatggggaagctgctggtcccacaccatttctgagttttctcctctatccttctgcttaaagttccctccaaggacttaagtgcaagtcatcccagaaacccaggtaggggagtagagaggccagatatggacaggaaggctgccaagaaaggggtgttaggcacaatggctcaggtctgtaagcccagaactttgggaggctgaggccggaagattgcttgaacctaggaggactgcttgagaccagcctgggcaacacggcgaaaccctatctctacaaaaaacaaaaa

SEQ ID NO: 32465 - DNA, 622 bp, Homo sapiens
attgacctccttcactgtgggcaggcatggtcccaccttctggaactcctcctggaatgggacatcaggggaagcaccttagcttagacagagtggctttgtgattaaaagcctggctcttgaatgaactgaaatccaaaggacctttggggacacgagaaggagaaaacaacatcattcctttcctttatttttggaaggctttgaagtccaacaggccctcttccttagctgtgtgcccttaaggcaaatcacttaacttttgtgaagactctgtttttctcttataacatgatgatgtgactatattaacaacaacaataatagtaataatatttcgagccgggcatggtggctcgtgcctgtaattccagcactttgggaggccgaggctggtggatcacctaaggtcaggagttcgagaccagcctccatctctactaaaaatacaaaaaattagctgagcatggtggcaggcacctgtaatcccagctactagggaggctgaggcaggagaattgcttgaacccgggaggcagaggttgcagtgagctgagatcgtgccattgcactcctgcctgggcaacatgagtgaaactccgtctcaaaaaaaaaaaaaaaa

SEQ ID NO: 32466 - DNA, 670 bp, Homo sapiens
gcggccgcctactactactactactgctcgaattcaagcttctaacgatgtacggggacatgggcccagagccgggacccccccagcccagccccgccctccccagactccgcgcaatcacatactgtatatagacgtgaatcgattttatttttattctttaaattaaggtcgtgataaagtgttgccaaagatacctgctgaattctcgcgtttcaggaaacaaacaaacaaaaaaaaatgatatttgaggagggtcgtgttgactccatatgaaaggacacagctcaaagcttttttgtttggttgtttggggttttttgtgttttctttttttggggtgttttttttttaactgcctggtacaaaaaaaaaaagagaaaaaaaaaaaaaagaaaaacaatgcgaaattgttatttccattctcatggtgaagttgcgtggacgcgtgtgtgcgtgtgtgcaagagagcgggagtgaggtccaggctggggttggggggcttcaggcgggggcgcccgggggccggggaggtggccgggccggagcccccgtctgcagtgccccccagcctgccgggcccaggagagagagagaagcatctttgctactagctgttgctgctacctgcctctgcccgccgacgccccccgccttttgagattaagga

SEQ ID NO: 32467 - DNA, 279 bp, Homo sapiens
ctatgaggatccccagcacagaggaggtggacagcactggacagcacagatggaggaagccatcgcaggggacctgggagacgccccgaggtgtttgtgcttcacccccagacgtcagcctcgaaggcaggactgtggggtgttcgtgctgtgttccccccgctccccctttctgtcccctttttgggttctgacgtgaagaggtcttagcgcccgcttctgtccacggggtctctccttcctctgatgatgtccagtgctgtccacctcctctgtgct

SEQ ID NO: 32468 - DNA, 5270 bp, Homo sapiens
gacgcgcgccgcagcgcgagggagcgaccagggcagcgcgacgcgggcagagcgagcgccgcggaccccggaggcgagcggccgagggagcccagtcccaacttcgggccccggccccgcgcgccccggcccggccccgcgaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatatatatgacgcgtcacagaatctagggtagcgctttctcagatttccctcctttctgacgtttttctccctccgcaggggccccggccctccctggctccccttccccccaccaccccatcgctgggtttcggggcttggtttggggttttttgtaggacacaaggaatccgagaccccgcacagccccctgggcacccggcatggggcctggggcccgatccgaggccctgggctggggggagggtagacgtgggggcgctggggggggactggggtgggcttttaatttcctcccctcgctggtttctatgagtctttcagacaagaccttaaatgatttctgtctgctctgagcggacgttaaaatgggcccccgtcccccgacccgcaccctccttcctcagggcacttactaagggaggggtctccctctccatctccccagtggcctccccgcctccaaccctgcctgcggcctccccccgtcgcccaccccacgtctcctggccactgagacacaaacctatttatttctaggcctggagaaaggagatcggactggggttcccggtggggcgccaggatggctcctgggggtgctcctgccgccttccttcacggcacttacaaccggcgggacccccagggaccacccctcagggcgcccccccacccccgcccggtccacctagacccccacgtttggagattcaaaacttctgtcttcgtcctctcccccgagccccctctcccaaatttttaaagcactttttagatttttttttctctttcctccttaaaaacaaaatttatatatagatatatatatatatataaataatatacttttcctcagaggagcaggcaacagtgtgggataaacagagtcacgatcagaggaaccccagggtctggtgatggcagggatggggggagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtcccctttttgggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggtgtctccctgcccccgacccccccatacccccttctctgtgacacacacatcttctcgtctctttttctttcattgttaaagggaagctttttaagaaggcaattttcatattgtttctaccggatggttttggttcccttcccttcccacccccccttaagcctgtcagccccctccaaatgtctcaggatcccccctctcccctggggctgggtgacagcaccccggctgcgttcacaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatcacagctgtcgtcctagccagtgggggcgaccggacttggggggtggagccctctgggacttccgtaggaacaagggctgcggcccaccgcgacacttacacagacctcggggattgcactaaaccctcgttcctagctccgcactcagcttcgcctgtcctgcccgcccactttgccttaactacccgcccgtcctgggggccacagcctctgcatgggcccagagccgggacccccccagcccagccccgccctccccagactccgcgcaatcacatactgtatatagacgtgaatcgattttatttttattctttaaattaaggtcgtgataaagtgttgccaaagatacctgctgaattctcgcgtttcaggaaacaaacaaacaaaaaaaaatgatatttgaggagggtcgtgttgactccatatgaaaggacacagctcaaagcttttttgtttggttgtttggggttttttgtgttttctttttttggggtgttttttttttaactgcctggtacaaaaaaaaaaagagaaaaaaaaaaaaaagaaaaacaatgcgaaattgttatttccattctcatggtgaagttgcgtggacgcgtgtgtgcgtgtgtgcaagagagcgggagtgaggtccaggctggggttggggggcttcaggcgggggcgcccgggggccggggaggtggccgggccggagcccccgtctgcagtgccccccagcctgccgggcccaggagagagagagaagcatctttgctactagctgttgctgctacctgcctctgcccgccgacgccccccgccttttgagattaagga

SEQ ID NO: 32469 - DNA, 4994 bp, Homo sapiens
gacgcgcgccgcagcgcgagggagcgaccagggcagcgcgacgcgggcagagcgagcgccgcggaccccggaggcgagcggccgagggagcccagtcccaacttcgggccccggccccgcgcgccccggcccggccccgcgaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatatatatgacgcgtcacagaatctagggtagcgctttctcagatttccctcctttctgacgtttttctccctccgcaggggccccggccctccctggctccccttccccccaccaccccatcgctgggtttcggggcttggtttggggttttttgtaggacacaaggaatccgagaccccgcacagccccctgggcacccggcatggggcctggggcccgatccgaggccctgggctggggggagggtagacgtgggggcgctggggggggactggggtgggcttttaatttcctcccctcgctggtttctatgagtctttcagacaagaccttaaatgatttctgtctgctctgagcggacgttaaaatgggcccccgtcccccgacccgcaccctccttcctcagggcacttactaagggaggggtctccctctccatctccccagtggcctccccgcctccaaccctgcctgcggcctccccccgtcgcccaccccacgtctcctggccactgagacacaaacctatttatttctaggcctggagaaaggagatcggactggggttcccggtggggcgccaggatggctcctgggggtgctcctgccgccttccttcacggcacttacaaccggcgggacccccagggaccacccctcagggcgcccccccacccccgcccggtccacctagacccccacgtttggagattcaaaacttctgtcttcgtcctctcccccgagccccctctcccaaatttttaaagcactttttagatttttttttctctttcctccttaaaaacaaaatttatatatagatatatatatatatataaataatatacttttcctcagaggagcaggcaacagtgtgggataaacagagtcacgatcagaggaaccccagggtctggtgatggcagggatggggggagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggtgtctccctgcccccgacccccccatacccccttctctgtgacacacacatcttctcgtctctttttctttcattgttaaagggaagctttttaagaaggcaattttcatattgtttctaccggatggttttggttcccttcccttcccacccccccttaagcctgtcagccccctccaaatgtctcaggatcccccctctcccctggggctgggtgacagcaccccggctgcgttcacaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatcacagctgtcgtcctagccagtgggggcgaccggacttggggggtggagccctctgggacttccgtaggaacaagggctgcggcccaccgcgacacttacacagacctcggggattgcactaaaccctcgttcctagctccgcactcagcttcgcctgtcctgcccgcccactttgccttaactacccgcccgtcctgggggccacagcctctgcatgggcccagagccgggacccccccagcccagccccgccctccccagactccgcgcaatcacatactgtatatagacgtgaatcgattttatttttattctttaaattaaggtcgtgataaagtgttgccaaagatacctgctgaattctcgcgtttcaggaaacaaacaaacaaaaaaaaatgatatttgaggagggtcgtgttgactccatatgaaaggacacagctcaaagcttttttgtttggttgtttggggttttttgtgttttctttttttggggtgttttttttttaactgcctggtacaaaaaaaaaaagagaaaaaaaaaaaaaagaaaaacaatgcgaaattgttatttccattctcatggtgaagttgcgtggacgcgtgtgtgcgtgtgtgcaagagagcgggagtgaggtccaggctggggttggggggcttcaggcgggggcgcccgggggccggggaggtggccgggccggagcccccgtctgcagtgccccccagcctgccgggcccaggagagagagagaagcatctttgctactagctgttgctgctacctgcctctgcccgccgacgccccccgccttttgagattaagga

SEQ ID NO: 32470 - DNA, 4481 bp, Homo sapiens
gacgcgcgccgcagcgcgagggagcgaccagggcagcgcgacgcgggcagagcgagcgccgcggaccccggaggcgagcggccgagggagcccagtcccaacttcgggccccggccccgcgcgccccggcccggccccgcgaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatatatatgacgcgtcacagaatctagggtagcgctttctcagatttccctcctttctgacgtttttctccctccgcaggggccccggccctccctggctccccttccccccaccaccccatcgctgggtttcggggcttggtttggggttttttgtaggacacaaggaatccgagaccccgcacagccccctgggcacccggcatggggcctggggcccgatccgaggccctgggctggggggagggtagacgtgggggcgctggggggggactggggtgggcttttaatttcctcccctcgctggtttctatgagtctttcagacaagaccttaaatgatttctgtctgctctgagcggacgttaaaatgggcccccgtcccccgacccgcaccctccttcctcagggcacttactaagggaggggtctccctctccatctccccagtggcctccccgcctccaaccctgcctgcggcctccccccgtcgcccaccccacgtctcctggccactgagacacaaacctatttatttctaggcctggagaaaggagatcggactggggttcccggtggggcgccaggatggctcctgggggtgctcctgccgccttccttcacggcacttacaaccggcgggacccccagggaccacccctcagggcgcccccccacccccgcccggtccacctagacccccacgtttggagattcaaaacttctgtcttcgtcctctcccccgagccccctctcccaaatttttaaagcactttttagatttttttttctctttcctccttaaaaacaaaatttatatatagatatatatatatatataaataatatacttttcctcagaggagcaggcaacagtgtgggataaacagagtcacgatcagaggaaccccagggtctggtgatggcagggatggggggagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtcccctttttgggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaggagctacaacctcagagttaagactagctcgcattaaatacatagatttacgggggggggggggcggggccggcccagggggtggagggggccagggagacccccatccctcgccggggctgcctggaggctgtggaccaggatccgatgcccaggtcccgccccccaccccaccccaggcccagaatcgaggtgccttggactttggaggggccaggcctggtgaatggggggcggggcggcgccctcagggtacagagcacagacagatagacattccagagactgtattgagagtctttataaagtgtgggagatttaaaaaaaaaaaaaactgataaaaatgcactttttgggagtggggagggagaagctttaaaagtaataaaaaacaaacaaaaacacaaaagatgaaaaaacaaaaaaattcatttttcttgtacataaaaaaaaaaaaagaaccactaaacgcagcctgttacgaccgctgccgcctcagtcgcctcatttgatgttctctgtgttttgttcgggggaggctggggagcggggatggggggcttggggggggtcccccttttccccttttggccctgaagagactgggtgggttgagcacctcgtccacaccacacctttgggcccagggtgaccggatcctgggtcccaaggagagaagccccaggtccccgacccttcctgctcttcctgcccggcctt

SEQ ID NO: 32471 - DNA, 4183 bp, Homo sapiens
atttcaggcctgagcctccgcgcctggcctagactttgtctcttaaaaagttaaaaaaggaaaggaaacggggttcagagaggcatagcgttttcccaaggccacacagcactcagggtccgaggccctctttagatgttcagaatgcgaaatcgcccccactcgtctcgtttttcgagggaccgtccccatcggggcaccgaaacctctggtgcacggtccgtgttctgcaagggtgatgatccagggcctgccgtgtccgtgagggtccctgggcggggatcgggggtccccggccccactgaccgtgcccgccccgtgccccgtccacaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatatatatgacgcgtcacagaatctagggtagcgctttctcagatttccctcctttctgacgtttttctccctccgcaggggccccggccctccctggctccccttccccccaccaccccatcgctgggtttcggggcttggtttggggttttttgtaggacacaaggaatccgagaccccgcacagccccctgggcacccggcatggggcctggggcccgatccgaggccctgggctggggggagggtagacgtgggggcgctggggggggactggggtgggcttttaatttcctcccctcgctggtttctatgagtctttcagacaagaccttaaatgatttctgtctgctctgagcggacgttaaaatgggcccccgtcccccgacccgcaccctccttcctcagggcacttactaagggaggggtctccctctccatctccccagtggcctccccgcctccaaccctgcctgcggcctccccccgtcgcccaccccacgtctcctggccactgagacacaaacctatttatttctaggcctggagaaaggagatcggactggggttcccggtggggcgccaggatggctcctgggggtgctcctgccgccttccttcacggcacttacaaccggcgggacccccagggaccacccctcagggcgcccccccacccccgcccggtccacctagacccccacgtttggagattcaaaacttctgtcttcgtcctctcccccgagccccctctcccaaatttttaaagcactttttagatttttttttctctttcctccttaaaaacaaaatttatatatagatatatatatatatataaataatatacttttcctcagaggagcaggcaacagtgtgggataaacagagtcacgatcagaggaaccccagggtctggtgatggcagggatggggggagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtcccctttttgggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggtgtctccctgcccccgacccccccatacccccttctctgtgacacacacatcttctcgtctctttttctttcattgttaaagggaagctttttaagaaggcaattttcatattgtttctaccggatggttttggttcccttcccttcccacccccccttaagcctgtcagccccctccaaatgtctcaggatcccccctctcccctggggctgggtgacagcaccccggctgcgttcacaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatcacagctgtcgtcctagccagtgggggcgaccggacttggggggtggagccctctgggacttccgtaggaacaagggctgcggcccaccgcgacacttacacagacctcggggattgcactaaaccctcgttcctagctccgcactcagcttcgcctgtcctgcccgcccactttgccttaactacccgcccgtcctgggggccacagcctctgcatgggcccagagccgggacccccccagcccagccccgccctccccagactccgcgcaatcacatactgtatatagacgtgaatcgattttatttttattctttaaattaaggtcgtgataaagtgttgccaaagatacctgctgaattctcgcgtttcaggaaacaaacaaacaaaaaaaaatgatatttgaggagggtcgtgttgactccatatgaaaggacacagctcaaagcttttttgtttggttgtttggggttttttgtgttttctttttttggggtgttttttttttaactgcctggtacaaaaaaaaaaagagaaaaaaaaaaaaaagaaaaacaatgcgaaattgttatttccattctcatggtgaagttgcgtggacgcgtgtgtgcgtgtgtgcaagagagcgggagtgaggtccaggctggggttggggggcttcaggcgggggcgcccgggggccggggaggtggccgggccggagcccccgtctgcagtgccccccagcctgccgggcccaggagagagagagaagcatctttgctactagctgttgctgctacctgcctctgcccgccgacgccccccgccttttgagattaagga

SEQ ID NO: 32472 - DNA, 4062 bp, Homo sapiens
gactggggtgggcttttaatttcctcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatatatatgacgcgtcacagaatctagggtagcgctttctcagatttccctcctttctgacgtttttctccctccgcaggggccccggccctccctggctccccttccccccaccaccccatcgctgggtttcggggcttggtttggggttttttgtaggacacaaggaatccgagaccccgcacagccccctgggcacccggcatggggcctggggcccgatccgaggccctgggctggggggagggtagacgtgggggcgctggggggggactggggtgggcttttaatttcctcccctcgctggtttctatgagtctttcagacaagaccttaaatgatttctgtctgctctgagcggacgttaaaatgggcccccgtcccccgacccgcaccctccttcctcagggcacttactaagggaggggtctccctctccatctccccagtggcctccccgcctccaaccctgcctgcggcctccccccgtcgcccaccccacgtctcctggccactgagacacaaacctatttatttctaggcctggagaaaggagatcggactggggttcccggtggggcgccaggatggctcctgggggtgctcctgccgccttccttcacggcacttacaaccggcgggacccccagggaccacccctcagggcgcccccccacccccgcccggtccacctagacccccacgtttggagattcaaaacttctgtcttcgtcctctcccccgagccccctctcccaaatttttaaagcactttttagatttttttttctctttcctccttaaaaacaaaatttatatatagatatatatatatatataaataatatacttttcctcagaggagcaggcaacagtgtgggataaacagagtcacgatcagaggaaccccagggtctggtgatggcagggatggggggagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtcccctttttgggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggtgtctccctgcccccgacccccccatacccccttctctgtgacacacacatcttctcgtctctttttctttcattgttaaagggaagctttttaagaaggcaattttcatattgtttctaccggatggttttggttcccttcccttcccacccccccttaagcctgtcagccccctccaaatgtctcaggatcccccctctcccctggggctgggtgacagcaccccggctgcgttcacaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatcacagctgtcgtcctagccagtgggggcgaccggacttggggggtggagccctctgggacttccgtaggaacaagggctgcggcccaccgcgacacttacacagacctcggggattgcactaaaccctcgttcctagctccgcactcagcttcgcctgtcctgcccgcccactttgccttaactacccgcccgtcctgggggccacagcctctgcatgggcccagagccgggacccccccagcccagccccgccctccccagactccgcgcaatcacatactgtatatagacgtgaatcgattttatttttattctttaaattaaggtcgtgataaagtgttgccaaagatacctgctgaattctcgcgtttcaggaaacaaacaaacaaaaaaaaatgatatttgaggagggtcgtgttgactccatatgaaaggacacagctcaaagcttttttgtttggttgtttggggttttttgtgttttctttttttggggtgttttttttttaactgcctggtacaaaaaaaaaaagagaaaaaaaaaaaaaagaaaaacaatgcgaaattgttatttccattctcatggtgaagttgcgtggacgcgtgtgtgcgtgtgtgcaagagagcgggagtgaggtccaggctggggttggggggcttcaggcgggggcgcccgggggccggggaggtggccgggccggagcccccgtctgcagtgccccccagcctgccgggcccaggagagagagagaagcatctttgctactagctgttgctgctacctgcctctgcccgccgacgccccccgccttttgagattaagga

SEQ ID NO: 32473 - DNA, 3058 bp, Homo sapiens
gacgcgcgccgcagcgcgagggagcgaccagggcagcgcgacgcgggcagagcgagcgccgcggaccccggaggcgagcggccgagggagcccagtcccaacttcgggccccggccccgcgcgccccggcccggccccgcgaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatatatatgacgcgtcacagaatctagggtagcgctttctcagatttccctcctttctgacgtttttctccctccgcaggggccccggccctccctggctccccttccccccaccaccccatcgctgggtttcggggcttggtttggggttttttgtaggacacaaggaatccgagaccccgcacagccccctgggcacccggcatggggcctggggcccgatccgaggccctgggctggggggagggtagacgtgggggcgctggggggggactggggtgggcttttaatttcctcccctcgctggtttctatgagtctttcagacaagaccttaaatgatttctgtctgctctgagcggacgttaaaatgggcccccgtcccccgacccgcaccctccttcctcagggcacttactaagggaggggtctccctctccatctccccagtggcctccccgcgcccagaatcgaggtgccttggactttggaggggccaggcctggtgaatggggggcggggcggcgccctcagggtacagagcacagacagatagacattccagagactgtattgagagtctttataaagtgtgggagatttaaaaaaaaaaaaaactgataaaaatgcactttttgggagtggggagggagaagctttaaaagtaataaaaaacaaacaaaaacacaaaagatgaaaaaacaaaaaaattcatttttcttgtacataaaaaaaaaaaaagaaccactaaacgcagcctgttacgaccgctgccgcctcagtcgcctcatttgatgttctctgtgttttgttcgggggaggctggggagcggggatggggggcttggggggggtcccccttttccccttttggccctgaagagactgggtgggttgagcacctcgtccacaccacacctttgggcccagggtgaccggatcctgggtcccaaggagagaagccccaggtccccgacccttcctgctcttcctgcccggcctt

SEQ ID NO: 32474 - DNA, 2541 bp, Homo sapiens
tattactagtgaattcactagtaatccccacgtttggagattcaaaacttctgtcttcgtcctctcccccgagccccctctcccaaatttttaaagcactttttagatttttttttctctttcctccttaaaaacaaaatttatatatagatatatatatatatataaataatatacttttcctcagaggagcaggcaacagtgtgggataaacagagtcacgatcagaggaaccccagggtctggtgatggcagggatggggggagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtcccctttttgggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggtgtctccctgcccccgacccccccatacccccttctctgtgacacacacatcttctcgtctctttttctttcattgttaaagggaagctttttaagaaggcaattttcatattgtttctaccggatggttttggttcccttcccttcccacccccccttaagcctgtcagccccctccaaatgtctcaggatcccccctctcccctggggctgggtgacagcaccccggctgcgttcacaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatcacagctgtcgtcctagccagtgggggcgaccggacttggggggtggagccctctgggacttccgtaggaacaagggctgcggcccaccgcgacacttacacagacctcggggattgcactaaaccctcgttcctagctccgcactcagcttcgcctgtcctgcccgcccactttgccttaactacccgcccgtcctgggggccacagcctctgcatgggcccagagccgggacccccccagcccagccccgccctccccagactccgcgcaatcacatactgtatatagacgtgaatcgattttatttttattctttaaattaaggtcgtgataaagtgttgccaaagatacctgctgaattctcgcgtttcaggaaacaaacaaacaaaaaaaaatgatatttgaggagggtcgtgttgactccatatgaaaggacacagctcaaagcttttttgtttggttgtttggggttttttgtgttttctttttttggggtgttttttttttaactgcctggtacaaaaaaaaaaagagaaaaaaaaaaaaaagaaaaacaatgcgaaattgttatttccattctcatggtgaagttgcgtggacgcgtgtgtgcgtgtgtgcaagagagcgggagtgaggtccaggctggggttggggggcttcaggcgggggcgcccgggggccggggaggtggccgggccggagcccccgtctgcagtgccccccagcctgccgggcccaggagagagagagaagcatctttgctactagctgttgctgctacctgcctctgcccgccgacgccccccgccttttgagattaagga

SEQ ID NO: 32475 - DNA, 2344 bp, Homo sapiens
ccgggctcgcaggaattcggcacgagatcagaggaaccccagggtctggtgatggcagggatggggggagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtcccctttttgggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggtgtctccctgcccccgacccccccatacccccttctctgtgacacacacatcttctcgtctctttttctttcattgttaaagggaagctttttaagaaggcaattttcatattgtttctaccggatggttttggttcccttcccttcccacccccccttaagcctgtcagccccctccaaatgtctcaggatcccccctctcccctggggctgggtgacagcaccccggctgcgttcacaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatcacagctgtcgtcctagccagtgggggcgaccggacttggggggtggagccctctgggacttccgtaggaacaagggctgcggcccaccgcgacacttacacagacctcggggattgcactaaaccctcgttcctagctccgcactcagcttcgcctgtcctgcccgcccactttgccttaactacccgcccgtcctgggggccacagcctctgcatgggcccagagccgggacccccccagcccagccccgccctccccagactccgcgcaatcacatactgtatatagacgtgaatcgattttatttttattctttaaattaaggtcgtgataaagtgttgccaaagatacctgctgaattctcgcgtttcaggaaacaaacaaacaaaaaaaaatgatatttgaggagggtcgtgttgactccatatgaaaggacacagctcaaagcttttttgtttggttgtttggggttttttgtgttttctttttttggggtgttttttttttaactgcctggtacaaaaaaaaaaagagaaaaaaaaaaaaaagaaaaacaatgcgaaattgttatttccattctcatggtgaagttgcgtggacgcgtgtgtgcgtgtgtgcaagagagcgggagtgaggtccaggctggggttggggggcttcaggcgggggcgcccgggggccggggaggtggccgggccggagcccccgtctgcagtgccccccagcctgccgggcccaggagagagagagaagcatctttgctactagctgttgctgctacctgcctctgcccgccgacgccccccgccttttgagattaagga

SEQ ID NO: 32476 - DNA, 1584 bp, Homo sapiens
gacgcgcgccgcagcgcgagggagcgaccagggcagcgcgacgcgggcagagcgagcgccgcggaccccggaggcgagcggccgagggagcccagtcccaacttcgggccccggccccgcgcgccccggcccggccccgcgaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggtgagctgcccgccgcgggggaggcgccgtcctgctctctgccccagcatccgccgctcacgacccctcccgcctctctccctgcaccgcacgcacacatgcacgcagacgcacacatacacgcacgtgcacacagacacgtacacgcacagacacatgcacgt

SEQ ID NO: 32477 - DNA, 4232 bp, Homo sapiens
gacgcgcgccgcagcgcgagggagcgaccagggcagcgcgacgcgggcagagcgagcgccgcggaccccggaggcgagcggccgagggagcccagtcccaacttcgggccccggccccgcgcgccccggcccggccccgcgaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtcccctttttgggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggtgtctccctgcccccgacccccccatacccccttctctgtgacacacacatcttctcgtctctttttctttcattgttaaagggaagctttttaagaaggcaattttcatattgtttctaccggatggttttggttcccttcccttcccacccccccttaagcctgtcagccccctccaaatgtctcaggatcccccctctcccctggggctgggtgacagcaccccggctgcgttcacaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatcacagctgtcgtcctagccagtgggggcgaccggacttggggggtggagccctctgggacttccgtaggaacaagggctgcggcccaccgcgacacttacacagacctcggggattgcactaaaccctcgttcctagctccgcactcagcttcgcctgtcctgcccgcccactttgccttaactacccgcccgtcctgggggccacagcctctgcatgggcccagagccgggacccccccagcccagccccgccctccccagactccgcgcaatcacatactgtatatagacgtgaatcgattttatttttattctttaaattaaggtcgtgataaagtgttgccaaagatacctgctgaattctcgcgtttcaggaaacaaacaaacaaaaaaaaatgatatttgaggagggtcgtgttgactccatatgaaaggacacagctcaaagcttttttgtttggttgtttggggttttttgtgttttctttttttggggtgttttttttttaactgcctggtacaaaaaaaaaaagagaaaaaaaaaaaaaagaaaaacaatgcgaaattgttatttccattctcatggtgaagttgcgtggacgcgtgtgtgcgtgtgtgcaagagagcgggagtgaggtccaggctggggttggggggcttcaggcgggggcgcccgggggccggggaggtggccgggccggagcccccgtctgcagtgccccccagcctgccgggcccaggagagagagagaagcatctttgctactagctgttgctgctacctgcctctgcccgccgacgccccccgccttttgagattaagga

SEQ ID NO: 32478 - DNA, 5333 bp, Homo sapiens
gacgcgcgccgcagcgcgagggagcgaccagggcagcgcgacgcgggcagagcgagcgccgcggaccccggaggcgagcggccgagggagcccagtcccaacttcgggccccggccccgcgcgccccggcccggccccgcgaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatatatatgacgcgtcacagaatctagggtagcgctttctcagatttccctcctttctgacgtttttctccctccgcaggggccccggccctccctggctccccttccccccaccaccccatcgctgggtttcggggcttggtttggggttttttgtaggacacaaggaatccgagaccccgcacagccccctgggcacccggcatggggcctggggcccgatccgaggccctgggctggggggagggtagacgtgggggcgctggggggggactggggtgggcttttaatttcctcccctcgctggtttctatgagtctttcagacaagaccttaaatgatttctgtctgctctgagcggacgttaaaatgggcccccgtcccccgacccgcaccctccttcctcagggcacttactaagggaggggtctccctctccatctccccagtggcctccccgcctccaaccctgcctgcggcctccccccgtcgcccaccccacgtctcctggccactgagacacaaacctatttatttctaggcctggagaaaggagatcggactggggttcccggtggggcgccaggatggctcctgggggtgctcctgccgccttccttcacggcacttacaaccggcgggacccccagggaccacccctcagggcgcccccccacccccgcccggtccacctagacccccacgtttggagattcaaaacttctgtcttcgtcctctcccccgagccccctctcccaaatttttaaagcactttttagatttttttttctctttcctccttaaaaacaaaatttatatatagatatatatatatatataaataatatacttttcctcagaggagcaggcaacagtgtgggataaacagagtcacgatcagaggaaccccagggtctggtgatggcagggatggggggagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtcccctttttgggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggtgtctccctgcccccgacccccccatacccccttctctgtgacacacacatcttctcgtctctttttctttcattgttaaagggaagctttttaagaaggcaattttcatattgtttctaccggatggttttggttcccttcccttcccacccccccttaagcctgtcagccccctccaaatgtctcaggatcccccctctcccctggggctgggtgacagcaccccggctgcgttcacaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatcacagctgtcgtcctagccagtgggggcgaccggacttggggggtggagccctctgggacttccgtaggaacaagggctgcggcccaccgcgacacttacacagacctcggggattgcactaaaccctcgttcctagctccgcactcagcttcgcctgtcctgcccgcccactttgccttaactacccaggagctacaacctcagagttaagactagctcgcattaaatacatagatttacgggggggggggggcgggggccagggagacccccatccctcgccggggctgcctggaggctgtggaccaggatccgatgcccaggtcccgccccccaccccaccccaggcccagaatcgaggtgccttggactttggaggggccaggcctggtgaatggggggcggggcggcgccctcagggtacagagcacagacagatagacattccagagactgtattgagagtctttataaagtgtgggagatttaaaaaaaaaaaaaactgataaaaatgcactttttgggagtggggagggagaagctttaaaagtaataaaaaacaaacaaaaacacaaaagatgaaaaaacaaaaaaattcatttttcttgtacataaaaaaaaaaaaagaaccactaaacgcagcctgttacgaccgctgccgcctcagtcgcctcatttgatgttctctgtgttttgttcgggggaggctggggagcggggatggggggcttggggggggtcccccttttccccttttggccctgaagagactgggtgggttgagcacctcgtccacaccacacctttgggcccagggtgaccggatcctgggtcccaaggagagaagccccaggtccccgacccttcctgctcttcctgcccggcctt

SEQ ID NO: 32479 - DNA, 4249 bp, Homo sapiens
gacgcgcgccgcagcgcgagggagcgaccagggcagcgcgacgcgggcagagcgagcgccgcggaccccggaggcgagcggccgagggagcccagtcccaacttcgggccccggccccgcgcgccccggcccggccccgcgaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatatatatgacgcgtcacagaatctagggtagcgctttctcagatttccctcctttctgacgtttttctccctccgcaggggccccggccctccctggctccccttccccccaccaccccatcgctgggtttcggggcttggtttggggttttttgtaggacacaaggaatccgagaccccgcacagccccctgggcacccggcatggggcctggggcccgatccgaggccctgggctggggggagggtagacgtgggggcgctggggggggactggggtgggcttttaatttcctcccctcgctggtttctatgagtctttcagacaagaccttaaatgatttctgtctgctctgagcggacgttaaaatgggcccccgtcccccgacccgcaccctccttcctcagggcacttactaagggaggggtctccctctccatctccccagtggcctccccgcctccaaccctgcctgcggcctccccccgtcgcccaccccacgtctcctggccactgagacacaaacctatttatttctaggcctggagaaaggagatcggactggggttcccggtggggcgccaggatggctcctgggggtgctcctgccgccttccttcacggcacttacaaccggcgggacccccagggaccacccctcagggcgcccccccacccccgcccggtccacctagacccccacgtttggagattcaaaacttctgtcttcgtcctctcccccgagccccctctcccaaatttttaaagcactttttagatttttttttctctttcctccttaaaaacaaaatttatatatagatatatatatatatataaataatatacttttcctcagaggagcaggcaacagtgtgggataaacagagtcacgatcagaggaaccccagggtctggtgatggcagggatggggggagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtcccctttttgggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggcgtaaagatctttcactaaattccatatgcggtctgtctggatgtaaacctatatattttcttgtgaaacagaatcctatcctgctgactcttgggactcctgcatagctttgaccgaatgtcactctcatcgtgatggaagatttctatctatgccgctgatacatgtgcttaaatactgagatctgtttaaacctgaatcttgctcactcccattggggactgtg

SEQ ID NO: 32480 - DNA, 2059 bp, Homo sapiens
aacaacggctaggtgcaaggtctgggtggtgagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtcccctttttgggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggtgtctccctgcccccgacccccccatacccccttctctgtgacacacacatcttctcgtctctttttctttcattgttaaagggaagctttttaagaaggcaattttcatattgtttctaccggatggttttggttcccttcccttcccacccccccttaagcctgtcagccccctccaaatgtctcaggatcccccctctcccctggggctgggtgacagcaccccggctgcgttcacaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatcacagctgtcgtcctagccagtgggggcgaccggacttggggggtggagccctctgggacttccgtaggaacaagggctgcggcccaccgcgacacttacacagacctcggggattgcactaaaccctcgttcctagctccgcactcagcttcgcctgtcctgcccgcccactttgccttaactacccgcccgtcctgggggccacagcctctgcatgggcccagagccgggacccccccagcccagccccgccctccccagactccgcgcaatcacatactgtatatagacgtgaatcgattttatttttattctttaaattaaggtcgtgataaagtgttgccaaagatacctgctgaattctcgcgtttcaggaaacaaacaaacaaaaaaaaatgatatttgaggagggtcgtgttgactccatatgaaaggacacagctcaaagcttttttgtttggttgtttggggttttttgtgttttctttttttggggtgttttttttttaactgcctggtacaaaaaaaaaaagagaaaaaaaaaaaaaagaaaaacaatgcgaaattgttatttccattctcatggtgaagttgcgtggacgcgtgtgtgcgtgtgtgcaagagagcgggagtgaggtccaggctggggttggggggcttcaggcgggggcgcccgggggccggggaggtggccgggccggagcccccgtctgcagtgccccccagcctgccgggcccaggagagagagagaagcatctttgctactagctgttgctgctacctgcctctgcccgccgacgccccccgccttttgagattaagga

SEQ ID NO: 32481 - DNA, 1279 bp, Homo sapiens
ataaaccagtgaatgtaaaatgccggagcaggcccggcctggcatgggtgtggacctgcagccaggcaggctcgagcgggcgataccaaagtctgcccccccaccattgtggccatgcagtcctgtcactgtctttttgcttccttccgaggggggtcccccagcctcttccagggtcttcccctggaagtgggcggctgcagggaaggtgggggacaggggtctttgcacgattcagaccccggggccgtggcaggagcggtcacctcacaggtggtgacactgaggcaggggcctcggggtgccccctcccgcccggcaaccagaatggttggaggcaagacagagagaatgaaaggaaaaacagaagaaaaaaaaatattaaaaaccaacaaaaaaagcaaaaatcctattttttgagaaagaaagatatttatatttgcagttttattttaaaaagttatttaagttgaagcagccttcctggaggtgggggggggggggtggtgggtggctggcgcaggacgggtcaggggcctggaggctgggggtgccccaggagctacaacctcagagttaagactagctcgcattaaatacatagatttacgggggggggggggcggggccggcccagggggtggagggggccagggagacccccatccctcgccggggctgcctggaggctgtggaccaggatccgatgcccaggtcccgccccccaccccaccccaggcccagaatcgaggtgccttggactttggaggggccaggcctggtgaatggggggcggggcggcgccctcagggtacagagcacagacagatagacattccagagactgtattgagagtctttataaagtgtgggagatttaaaaaaaaaaaaaactgataaaaatgcactttttgggagtggggagggagaagctttaaaagtaataaaaaacaaacaaaaacacaaaagatgaaaaaacaaaaaaattcatttttcttgtacataaaaaaaaaaaaagaaccactaaacgcagcctgttacgaccgctgccgcctcagtcgcctcatttgatgttctctgtgttttgttcgggggaggctggggagcggggatggggggcttggggggggtcccccttttccccttttggccctgaagagactgggtgggttgagcacctcgtccacaccacacctttgggcccagggtgaccggatcctgggtcccaaggagagaagccccaggtccccgacccttcctgctcttcctgcccggcctt

SEQ ID NO: 32482 - DNA, 128 bp, Homo sapiens
ttctttttatacaatcaattttatcaatgtgttttatcaattttcaacatttggtaagtttatgggtatttcacattcaatctgcatgtaaaaataatattgcaacacaggaaaacacatttaaggca

SEQ ID NO: 32483 - DNA, 769 bp, Homo sapiens
tttaagctcctcactgcaaaagacaaaaaaatcacagctctgggcagtcattctctcctttggctccagacaggctggccaaccacaggtctttctccaagctttgccatctctttggaatgtccattcccctttgggaaagtcttttctaaacctagttcaatcctctgtcaagaagcctcactgatcgctgaagcccactggtccagccccttgctcaagcccaagcagtgactgggcacaatactgatgttataatgcctagcactgcttatttaacctttttagggcctggcttccatccctctctaacacttattgaatattgtctgtgtcagtttatgcttttttttgcaatctcttgtctaagtcatacaacagccctatgaggtcttccacacccattttacagaggggaacatggaggtccagagaggatatttgctctggattgtgtagttcaaatgcacagtcacgatttgaacccagctcttagccaaccccaaacccccaaatctgagcttgtcatcaccacactgcagtgcctggttgacagtggccttctttataggctacctgtcaactgaatgaattacttactggctcttccctggtgataaggaaagaaaatgagaccacctctacttcattgcctccattcccgcagctggggtaggagagtgtgtgcgtgtgccaggggatgaggcaaatggacacacaggccaccacagtttctgagcctcagttttctcatccgcaagacaggagc

SEQ ID NO: 32484 - DNA, 302 bp, Homo sapiens
aatagtttttgtattttctaaagcctagagatctgaaagattttttaaaagacccaaattaaaccactagagatgaaaaaaattatactacataagatgaaaatacatattagaccagactgatggattactcattgtagaaaaaagtcaccttgaagacatagcaatagaaactacccaaaattgaatacacagagaagagagactttaaaatcataagcagaccatacgtgagttgccttcaagcaaccaaatatatctgcaattaaagtcaccaaagcaaggcaagaagggcaaaacca

SEQ ID NO: 32485 - DNA, 1744 bp, Homo sapiens
  misc_feature (953)..(953): n is a, c, g, or t
catgggtcttctgggtctgttagaataattaccaagtatttggatagttaaaagttgcaacgctagggtcttttatacttgctctaggacatagttgtcaggtatgaaaaatttaccatggcaagatccatttgttgtattaatcactacctttcccttagagttgatttatggttcagagggatattctggaaaatgcttagatcaaacaagaccacattcattcatggagaaagagtggaatgcaggttcgtagtaaagaaaaataatttccagggctcctgggaaaaagctttggtcacttaaatgcccttgggctttctgtaagtaaacatctgcagtcctctctattggttttctagcatatttcacacaaaagcaggggagcagagtagtgttaattaccctgagccaagtcagtattaatctcaggtctccattgttgtttaagattgatggataaagatgtgactgcccagaactacctttgttctcttactggaaagatgtggacttggaggggcaatctggagttaatagtcagaactagattgtatcctccttactgggatgtgagctctgtcacctgagtaaccaatttctttgtaaagggatgtaatctcaaatcttagctttcaagctgccaggcttggtttgcttttatatccccaaatggaaccggaaccttctttattccaatggtacattgtggtagactgtattcggcaaccttttgtatgaaagggttaacatagatctgtctcatcagtgtctttctgtttaaggatagcataaaagtgctgattgttaacttcacttggtcctatgcttattctttatttttactgtaggatttactttttcttttcctgtgtctttctctctccaaaaaaaaaaaaaaaataaaatctaccttgatgtgtcaaagagataaagaagatgttataaacatnaaacaaaagttcacgtttctgtttctttgtgcccccggtcccccttttaaaaataggcctcacagcatcaggcatttgccagtgcagcagttttgaagcataggatttttccccttcctgatgtataaatgccagctctcttcccccctttgcagacacaggcattttcctcttttgagttttagttttatgatagcacattacaaagagtttgacagatcctttaagatgaagatctgttgatgtacttcctgtttatggtggctcccagcttcactggtgatgaggacacaggcgcctgaaacccagaggcagggtggatctgcaccacttctctgaccttgccagggctgaccttcatcattctaagggaactttttttctttttttcccctccctaagcagtggttctcaatttggggctattttactccagaaggggcttttggcaatgtttggagacatttttggttgttacagcaagacttggagctaccagcctctagtgggtagaggccaaggatgctgctgaacattctacaatgcactggactgtccccacaaaagaatgttctgtcctgaattgttgatagtgccaaggttaagaaaccctcccataagggatgttttctaggcttaaacagtggcctgtatgtgtctttctccttatttctttatttcaagaaaagaaaaacgctgccaaagcaaaagccatgcagtatgttcataataaattaccttttaaaacaaatcccaggcctactcttcccgaaaatgggaaagacaaaaaa

SEQ ID NO: 32486 - DNA, 661 bp, Homo sapiens
agacggggtttcaccatggttggccaggatggtttcaatctcttgaccttgtgatcagcctgcctcaacctcccaaagtgctgggattacaggcatgagccaccgcgcccggccaaaatatccaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaa

SEQ ID NO: 32487 - DNA, 843 bp, Homo sapiens
gaagaacgtgagttggaaaaatgctgagccagtccctggaaaacctgggtcctggcctggattctgtccttagccagctcttaacaaatcccttaacctcactgtctcctctccttcacaatagagttagtaattcccatccaactggcttcacaggcttttgtgagcttatgaatgtgaaagtattttctagtttataaaacactatatgaatgtggggaaatctttacttgaccttagggcatggagggtggagcacattttgtctgctgtttggacttggatgctgattagcagttatgaagtggcccagacacctagccattctttagtaagagtgaagatagcattttaagccctccttgtgtgcctagcatcttactgaacactttctggtgattctctcctttaatcctcacaaagatctcacagttgtcctccattttacggagaagaaaccgaggctccgagaggttaaacgatgtgcagaggctacctgtagtgatggtgctgagtcaagcctgtcaaccactgtgctcgttagtgaccaaggctgctttgacaggctgccagcttgtcagtggtttgcagccccccagacatttgctttcctacttcccatgcagttggggtgcctgcaagtgccaggttctctttggagtccatctgtgccttgtcacccaaaggagggcctcgagcatcacaaccgttgacatttcgaaacgtggtatctctacaacctttcattctcattgggattaccttgccatttgaacaccatcatttttggggactggtaaaaaggttgcctaaccctcacagggaacacacagttccctcaga

SEQ ID NO: 32488 - DNA, 512 bp, Homo sapiens
ttctttcccttaattatgccaagttgactgaagcagtgatacaggctggaaatatccaccatggttatttcagtttttgaactttaagcacagatattttgggaagtatcggggtgtgttgaatagttttcaattcatttattatttcttctagagaaattgacttgtttttgaaaacagcagttcagaattagataactacacgtgtttgcaaggatcccccccaacctggaaaaatatccttttcagacagccataataattcatagaaccaggattgattcagagaaattgtgtgacaggttgatggtctggaggttccaacctcattcacaaacctcagctctgtaggaaacagtgtggaccagaaatgaggccagaagtagtttcaccttcctaaactcaagccttttggggaggtctgcctcttattccatttattctattttagccacatttcagatgtgcttacttatctagttacttgcttagctcacttatttaaaaaaaaa

SEQ ID NO: 32489 - DNA, 347 bp, Homo sapiens
cctttttcagattgtgcttccatttaaaaaaatgagttccagtttaaaaatatatatatatgctggactgggcatggtggcttatgcctgtaatcccagcactttcggtggtcaaggtgggcagatcacttgagcccaggggttcgaggtcagcctgggcaacataaggagacctcatttctacaaaaaaatttaaaaattagccagaagtggtggcatgcacttgtagtcccagctattcaggaggctgaggtgggaggattgcttgagcccaggaggtcaaggctgcagtgggctgtgatagtgccactgcactccagcctgggtgacagggtgagaccctttct

SEQ ID NO: 32490 - DNA, 343 bp, Homo sapiens
cttgttaacaaggccttagtgcatggaagatgcagatcacaggttctccattcaaaagctactccaattctcccagactacatatgcaggtgaattaaatttaactacagactaatttagcagtacagaaacatgtcacacatccattcttttcacaatacaaaatataccacccttatggatatacacatttccttgtttaggatgtccttaacttcaatcgagatgtgaattttccagtaaaagagacactaaactgtcatttctttaaaggtttcacacactcaaggggcattcagtgcttactgtctactaaagacaaagtcactgccaacaaagccca

SEQ ID NO: 32491 - DNA, 384 bp, Homo sapiens
taaaaataatgagatatgttggggatgggaaccaagtctaaacacaaaattcattcgcttcatatacaccttataaacatagcctgaaggtagttttataaaacatttttaatactcatgtgcatgaaaaccaagttttgactgaaacctgtcacatgaggtcaagtgtggaattttccacttgtggtacgtcagtgctcaaaaagcttcagattgtggggcattttgagattagaaatgctctctacctgtactactttcctatgctgacacacacacacacacacacacacacacacacacacacacacacacacatttttggaggtgcattttcactctgttcgaccagccggggccaactgggcgaaccccattctctat

SEQ ID NO: 32492 - DNA, 542 bp, Homo sapiens
tgttgggttatttgtatttttatagttggattgtaacagttctttagaaatcttgggtatgctagaccctttcagatataatttgcaaatatttccttccattctatgggttatctttccactttcttgatggtgccctttgaagcacaaaagtttttaattttgatgaaattctaatttatttattttttcattgttgcttttggtgtcatatctaagaaaccattgctaaattcaaggttataaagatttattcctatgttttcttctaagagttttatagttttctcttactctaaaagtgtttgatccattttgagcccatttttatatggtgtgacataggtttctgtgatggttaattttatttgtcaacttcactgggccaggggatgcctagatagctgcttaagcacaatttctgggtgtgtctgtgaggtgtttcggaagagaatggcatttgaataggtggactgagtaaagcagatggccctccccaatgggggtgggcatcatacaatcaattgagggcctgaatggaa

SEQ ID NO: 32493 - DNA, 1033 bp, Homo sapiens
atttcctgaaaggtttttactctcttttccctccaggtctctccaagacaatcttctactttttcttaatttctgcttatcctttagacttcaattcaaatgttagttccttggagtagccttccctgatgatttccctgatataccatcccctctcctctcaacctaggtttagtgcacctgttttgtgctccctgtttttttccctatgcaatatttgatgcatttgattgtactatgtagttgtttgtcctgtcttttgcatatgtaaactcagtagataaggacagtgtctgatgttcctgaccattgagtctcctgtgctaatgcaatgcctgacacatatttggcacttaaatatttgttgaattaatctatattcttttctctccttcagcttccacttaaaactcagtcactatcatgcaactaaaacttctcttagtaaaaatttttaataattttcctaataattaaattcagaggtttttttttccagctcaatggattcaccaggatgtctcacaagtatttccagcctaacatgttttattttgaactctttgtctgccctcactgctttcccatgcccagtatccctttcccatacccaacatccctttctcccaaaaaagaaaagaaaaaactcttctctggcatttatgactcttaagaaatgttggataagacgctcctaatacatttgcacactcattcctacacagtcatgtattcatttgttaataagttctgacttgggtgggtgtgggtggctcacgcctataatcccaacaccagaagtccaaggtggaagaatcgcttgaggtctagaattcgagaccatccttggcaacatagtgagaccccatctctacaaaaagtaaaaattagctgggtatggtggtacacacctttaggcccagctacttgggaggctttggcaggaggatcacttgaacctgggaagttgaggctgcagtgagctaagattatgccactgcactccatcctaggtgacagaacggcagacacc

SEQ ID NO: 32494 - DNA, 622 bp, Homo sapiens
caagatcatgccactgcattccagcatggctgacaaagtgagacaccgtctgaggaaaaaaaaaattaacatctatactctattatagattacaaatattcaaagaaccaagtgcttaacaaaatacacttattgttctctaccttcctattttctttaatttctgatcagaatgtaaagacgggacagaaggtgtctcctgtctctcctgagacagtagagtatggagtactatcttttgataatggcaagctacctttcggaatctaacttactctctcctgagaagattctaggggtacttcaggataccaacaaaagagaattgttatttacatcatcccagtaatgtactatatagagatatgtgaaagtgagtaagtattttaccttcaggagtgggtaaattagcttttattatatgcgattattctgtgaggtgggggaaaaaactctccattaggagaaactggtgcctcataaagttagcatcttggccttacagtaataaggactttctaacttattgtaataaatgaaagaacatattcccatagggctttagccattattaaggaacaacttccatcttaagaagcttagctgaaaaaagaaatagggg

SEQ ID NO: 32495 - DNA, 540 bp, Homo sapiens
gtgtgctacatcaagcagagattaactgagttcatgaactggaagacacctaatgcagggtacacaacatatgatttgtatttgatccttttatctccttcagttttcttttctacccactgcatcctatattgggaaatgtctggataaataatgggtttgtcatctggccactaacttgtactttgcatttggcaaagacaacttgttaaaagaggaaatcacaatactataaagctgaaagggacttcagctaagttcacagagatgcctagtaactcactaaagccactaataatgacagagccaagggtgtgacagtgtctgaacctgccttaaatcctcttattccttagccactgcctttgttaccataccatgtcctctccaagaggacacactcaactttgtgccactgtgctcctgacacagtaatgcagacgatatggtagaaaaagtacgccccctggagtcagaaagactttgattaaatacctatgtagtgaatgaatagctgagatcttcagcaagttactgaac

SEQ ID NO: 32496 - DNA, 588 bp, Homo sapiens
atttcagcatacatggctttcaaaattatgaggcatgaaagtgtcaaaagcatctccagaaactcatgccgccaggatctgagactcaaaacagtgtggatcaaacaccatcaaagtgtggggtggggcaattcgagtttgtttccttgtttttatgtaagcagattaattagagaactaacataacgccagtctttgggcttttgatcctatcctgccaggacccagacttggagatgtattaaatggattcttccttttctaaatggaagaatctgcccttctcggcttcatagctcttctcaaagtctctgtcttggaccctcccgttagttactgagaatggtatactaacatctgagaaaggttggattcctcctagggacagaaaatccacatatggaaagtgcaaatcctgtgccgggtaatcacgaaagcagttgcagtagcattggatcatagagccccaggagacctcacaattcagcccccttcctggcaacactaatgaattaagaggtcagtttggtaattccaaaggctaagcctttgtaactataaataaatgcacagaatgaaaggaatgta

SEQ ID NO: 32497 - DNA, 422 bp, Homo sapiens
cagagtctatatgtcatactgggttaggttaattagctgttttgtgctaatcatttcacagtgtacacatatttcaagacatgtacactactaatatattcagtttttattgtcagttgtacctcagtaaagctggggaaaaaaatggaaatgtttaactcatatagaaattactgtattagatgtgtgttttgttcagttgccctgccagaagaaaaccctcagctagggtcaggcttagagatgatgctctagtaaacatctgtagaatgaaagtatgcgtagatggaagaactcctcctaattagcagtgtttgcccattccagtgttctgcatggaatcagtatgtattctactcattgcctgtaaaaagtttgaagtttaaatttgtgtagtaaaagcatctttgatatttctgttg

SEQ ID NO: 32498 - DNA, 527 bp, Homo sapiens
aaccagccccgagtgtggctgagaccccagaagggaggagggtgccttcctctcaggacacaggatagcgtgtctcccaccaccctaggggagccccaggattctcccacattcttggtcttggtggggtgtgatcctgtgatggttaatttatgtgttagcttggctaagccatggtacccagacatttggttaaacagtagtctcaacgttgctatgaaaggactcttcagatgtgattaacttcttttgtttctggagatagggttttgccacattgcccaggctggtcttgaactcctggactcaggcaatctgcctgcctcagcttcccaaagcgctggaattatgtgccactgcacctggccaagatgtgattaacatttaaaccagcagactctggagtgtgagtgggccttgtccaatcaggtgatggtaaagatggcggctcccgcaaagaggaagggttctccctgcagtctcatcaattcatccctgggtctccagcctgctgagtaccacttttt

SEQ ID NO: 32499 - DNA, 1314 bp, Homo sapiens
gaaaaaaaatgaactattttgtagcattgaacaagggtaggttccttgaatagtgccttgaaaatcatttacttaaatgctatcattttatggatactgaaagtgtgacatcagtgcccaagattacatggcttaaacttagagggtagggtgggacccagaatcctgacttgtgaatctcccttgctagagttttctgcctcatgccagagcctcctcctgcacagggatttctcacgccctccccaccctgcagcttcaatagggattttccctggacatactggctgctcttctccatagtaggcatttttccatgaagcaagtgtcattatgcccatgcacagatgaagaaactgaagccatgcatatggaggaagcaaaccaatacacatccaaagcaatgcacatccaatgacatggatgatccaaagccactcagctgtaactgctggagctgagacttgagcccagtgctcctaacccctgcattagtgccattctactgatgccaggttgaaaagaagctgtacacatgcagaagacacttttgggagcctttgcaatagcagatgttttatagctgagcagatcaagctgggaagaaatggtcgcttttcatagccatctctctgcacttgttggccttccctgacagtagcaacgttcttcattcttagatccctttcatcactaaggggatgccactaaactgaatttcttagcatggaaatgttacattccagggattgattttcctgcatagtatttctagaaaagttaatcgcctcattagtcatatttacattttattttaattgcatcctcgagagcaaatgtattcatttttttcctatgttatagttctctctttaacaaccccttaataaagcagagacaagatcagagcacatgaagagcactttgctttcttaaaatatgccacctcccaaaaatgtagggcccaattatcactgcggctataagctaattatcagatacaaaatatggatcacaactaattatcagaatctgaccttatttccaagtcatagattcctataaactaggttaacattagagatttaagcaggaactcaagaactgcagtaacccatggaaatgaatgtttatatttctaacaaatggctaaggcaagagatgattttctgaggcttatgtctggtgaaattttccagaagttcacgctctgcaaggccttattagtagaacatggatgatgaacggtccatttcattagtaacctgaaaccttctatttggagataaagatgactgcttccatttaaaaaaa

SEQ ID NO: 32500 - DNA, 1011 bp, Homo sapiens
ccgagtgccccggaggccttgaggctgtcatcgtcacctgctgcctccaggaaagaatgcaaaaccctaaaataggaaatgtggggccagcagaggaggggccggcacgcagtccttgaaagtgggggctgttgcccgccgcctcttcttagggtaagaacggggagagtcatcaggcctctgtctgtggaacagcagctccattcaacagtcatcaaagagtttgctatcttcttcaaactttgcagccaatctcacccacggattgaagaagacaacttgtaaataacaggaggaaacttaagtagagcatttaattttctcttcagttaaaataaaaaaagtaaatgctggaaatggaaatgatgacgagaaatatgcaagaaaataagccatgatttttctggcacagcactttatctttacataaaattgggattttgttgataagcatttttactgaagccaaaaagacctctccttcagttatgtttttaatcctaacatctggatagaaattaattgttccatttacaaattaaatgaatcttgtgaagaataatgttcaccaataaaatgtgcctgaaagatctggaacatcagaatttttcttcctgtaaaccacaaaaaagaatttttcatatgaaagaaaaccatgaggtttatggagctccagagcgtttgtgagcaaatccaccggggaagcccatggtggcatctctagactcaggtgagggtaatgcgtctgcagagtgagcctcagcattgggaccctgtgtgaccaaaggcaggacacggccatcgcagcacagaggggtcaccgacgcacaacagggctcccggtgcacccgcagcagctttcttcaaaattacccagacattagagcaatgctagcccctcaacgtgggctccaagaacgtgggaagtcagcctgccagccacaaagctgccacgtcctcccatccgggtgtgaataaagcacccacaaatgcctccttagttggaactga

SEQ ID NO: 32501 - DNA, 358 bp, Homo sapiens
gttttgtggctaacactgtaaacctcagatagatatgtcactgcagactggcatatggaatataaatgagatataaaagctgttttttccaacgtaacaccaggtgagctccttagaattaaagaaaccaaaaccatgctgtgaaaaaaaactttagatcctattgctttctcctaattacaacaagagtaacatgcaaaggatattatataagagggatttttaaaagacacttttagccttaaataaagcttcactgaggtttcattgccacaaggattgaactcaaggtaaaaatagggaatttgagcctttgagcctctgtccacaatgttagacattcaaggtcctctccctc

SEQ ID NO: 32502 - DNA, 585 bp, Homo sapiens
  misc_feature (489)..(489): n is a, c, g, or t
tttaaatccagaacaatggagccagctgacagaacagatttctgacacttgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctctnccaatcaaatgtctaggcttgtttgacttccacccccaatggtttttcactcttttatttacttcattttcctttaataacttaatctacttcatg

SEQ ID NO: 32503 - DNA, 810 bp, Homo sapiens
cacattccccacagggaaaacacatttctcacctcaaaagaagacaagacaacgagcaaacaagaaggagcagcaggaggggttctgagccgaggatgccgggcagacatgagggagacacgcacccccgaatccaaccagtgcctcggcacaacgacaaatgtcttcacgtcacagacctttagaggctcctgggcagagcctgaaccagggctcctgactggtctgtttggctcacatggtgttgagattttgccatcactcaatattcagatttcttataaatatccagatttccagcttctcttggaaaatcagaaaaaaacagcactgaactcctaggcccacaaggcactccccagtgaacagatgaaactgtcctctgctgcggggcaggagtctccaggtcacccccatccctccccacctgcctggaccctgaagaagccttctgagtctgtggctcaacgtgcgatgtgcagtgcaagggcctgccccgtagcctgccccgtaggctgccccatagcctgccccgtaagctgccccgtagcctgccccgtaggctgccccgtaggctccatggccactgccccacaaggcctgtctccacaggaatgggaagcggacagggagacgggcagcagctcacatgctgggacaacgcagtgttcaatccattctccatccagcagctccagacatctttccagaacacaaacctgaccccatcacctctctgcttagccactggcttaaactgccaatggtttgcctgcatgtaaaataaagccattctttaccattaaaaaa

SEQ ID NO: 32504 - DNA, 399 bp, Homo sapiens
gtggagaccatgtggagagcagaaatgatgcattcctaccacgactgctcagagaggtatgagtggagacctagggaggaaacgagcctggaattctacccacacctggcagtagcaagatggcatctgcaccccttctgcactggagtggggtcaaaggaagccagctaaaacagagggtttaaataagatccacagtgtcattatgtaatacataaagatttcaatcaaaaatcatctatcctaccaagaaacaagatctcaaattcaatggcaaaaaagtcaatcaatatatgccaaaatcaaaatgacagagatgttggaattatctaatggggagtttaaaggaggcatcatagaattacgtcaataaacaattatgatcatccttgaaacaag

SEQ ID NO: 32505 - DNA, 413 bp, Homo sapiens
aaaattcgaaactgtagaatctcatgtgcttgtggtagcctcctaccaccaggagaactttaaccaagtaccaaggctgaagctagcagttagctcaccatagtttttaaggtgccctaatcaaaattttaatataaaaattataaagcacgtggtggctcacacctgtaatccctgctacttgggaagctgaggggggaggatcacttgaggtcaagagttcaagaccagcctgagcaacacagtgagaccctgtctctccccccaaaattggccaagtgtggtggtatatgcctgctgtcccagctacttgggaggttgaggcgggaggatcacttggagtttgaggctgcagtgaactgcaacagtgccactacactccagccagggtgagagtgagacccctgtctctc

SEQ ID NO: 32506 - DNA, 522 bp, Homo sapiens
  misc_feature (500)..(500): n is a, c, g, or t
attcggaaacaagaatggccatcccaccacgacagcaatgtcaagccagtaagccctgacttgcttttcatagctgccacccccaggtaggagtcctgggagctggtgaaggacagctgctctgtgagcttcaaggtcttctttcagaatgccattgtgattacagagcctataaaataaaaaagatgctgcaggagatgcttatttaagcacagatcaccagcttctagaatctatgatggttcttcatggtttactgaaatatatctgtaatataatctggacattaaaatgcagcaactatactgtctctcaacaaagacataaaatggggcagtttgaaaaacttgtttgcgtgtatgcggcaattttaaatccatcagaggaagtaacttttaaccctttgttgactttaatgatgttcaaatccacagctgggcaatctcgttccacattccacctgaatgacaggtatgctaggctccgtggcccgattcttngggcctcgagggggcccaattt

SEQ ID NO: 32507 - DNA, 749 bp, Homo sapiens
agacagagatgtctgggccttgaccaatgagatcttcaggagtacttcagcagctgtttcggatttttctctgtggatgtcctcatgggactaagtggaaattggaaaagtatcatcaaactcttcttgagattcctttttgataaggaagattgcagaaaaatttgtggctgaagaggatgcactgagaagaaagataactgcccttattctaaatcccaatcttcaatcaagtactaagatggtctgcactttgcctgtggcgatttccttaggtagctggagaggaaacctcggtggtggtggtgacccacagactgccctgctgggaaaatgcactgaccagtcatcagcaaattctagcccattcagcagctgggcaatctcgttccacattccacctgaatgacagtgtttttcagagggttagcctggcagccttgcaaggatggagttggtgaggagagagacctgaggcccagagaccagtcaggagactgactttgtgctgtaggtggcagaggaagagcaggttagtactgtgcagtactggaaactggctgacactccatggtgctggtggatgctgcagtgggagcaggttccctccatgcattcggcacaatgctgagcatacaacttaatgatactacatgtcaaatgacaagctgaaacttaaacccagatgaaagaaattcatatgacacacttatctttacagtatttttttttttttaataaaaatgaga

SEQ ID NO: 32508 - DNA, 591 bp, Homo sapiens
agacagagatgtctgggccttgaccaatgagatcttcaggagtacttcagcagctgtttcggatttttctctgtggatgtcctcatgggactaagtggaaattggaaaagtatcatcaaactcttcttgagattcctttttgataaggaagattgcagaaaaatttgtggctgaagaggatgcactgagaagaaagataactgcccttattctaaatcccaatcttcaatcaagtactaagatggtctgcactttgcctactgccctgctgggaaaatgcactgaccagtcatcagcaaattctagcccattcagcaggttgaaaagctactgaccaggaaggtcatttccagcatttcccatagcttcaagattactagtacagacgcagaaggtaatgtaaaacaaagccacttaatccggtgaagttttcttgtgacagggtccctttaaagactattatcctgatttccatccaccctttgatagaatcaatgtgtactagatttaagcagaatcctgtaaatatcctccctatttatatctttaacataaaacagcctaagtggcacatgacaggtgaggagaaca

SEQ ID NO: 32509 - DNA, 401 bp, Homo sapiens
ttcaggtatttcagcaaaaattaaatacctaggaataaacttagatgtgcagggcttttatcaaggacatgacaaaattttgctgagaggaatgaaagatttgcattctatgttcctgaatgagcagatttcatgttataaatatgttatcaccatgtcttcatattaatttataaatgtaatttctgctgggcacagtggctcatacctgtaatctgaacagtttgggaagctgaagtgggtagatgacaattagctgggtgtctgtggcacacacttgttccaactacttctgaggccgaggtgggaggatcgcttgggcctgggaggcagaggttgcagtgagccgagatctgcctctgaactccagcctaggtgacagaataagaccctgtctcaaa

SEQ ID NO: 32510 - DNA, 369 bp, Homo sapiens
ttgctggcttaactgctggattttgacacccatttttgtccaatatgtaaataagtcactagaactacagatgggtaatgtttgcgtttatcttaagacccagttaaggccgggtgcaattgctcacgcctgtaatcccagcaccttgggaggccaaggcaggcagatcacaaggttaggagttcaagaccagcctggccaacatagtgaaaccctatctctactaaaaatgcaaaaaattagctgggcctggtggtgggcacctataatcccagctacgcaggaggctgaggcaggagaatctgttgaacccgggaggtggaggttgcagtgagccaagatcacaccattgcactccagcccgcgtga

SEQ ID NO: 32511 - DNA, 506 bp, Homo sapiens
tctgcagctcagagtgggagttggcctcagtgctccccaagagctcagagtgggcgtggggagccccagaggtgggtagcctggtcttagctccttgactctgctctgcagaggaaggagccaggactggagccacagccctgactcttggggagacgggcacatagttgacacccaaggaataaaactgccctccccttgccactaggctcagagggtctctaacagcctcgctgcgcaccttcagaaagtgactcatggagcctcaggttcatcgtgttcaaatggacacacagctccttgcggggaactgaatggggcccaagcaatgtaggagaatgtcctgggtgtggagacactttgtaaagcagaaacttagggctggccttgctcccaaccatgctgtggtcttctcacctgtccataacaatgacaggcaactgctcagaagaactccctgggcagcgggcacagccagagtggaggtggaaggaataaaggaaata

SEQ ID NO: 32512 - DNA, 423 bp, Homo sapiens
accaaaaataagtagaccaagtgcaagtcttctgattgaacagtgcccagttccagagtttatcagccatgctggtacttctcaagaaggagttgagagaagccttccttggaaagctagcaccaccaacaggaaagactagcaggtactgactgggagcatccctgttgggaaaggcagctggccatcaggtcacctcatattgacacatgtcagtcaaaagccttgcttcactcctagacccagaaccttcagtctgcaatttagtgtctcgctcaagaaaatgtaatctggcaggtgtcattagtatgtaaggaagcctctaacatgcaacaaagagattaaggtagccaataaataaactaaaaataaaataaacaggatagagatttggagcaacatagggagaccgcttctctacaa

SEQ ID NO: 32513 - DNA, 346 bp, Homo sapiens
aaggggctaaaaaatactggtttcaagtttggagtcattatagcactttttttatgttaatgggtataattcatgaaaaaggataaaactgaagacacgggacagtgaaatcataattccagaatctaaatctgtgtgttggcaagataggttggaacttgaagtggagtgattagtcttagataggagcagggataattctattgtgatcctagggaaggtgcagcatatgggctcatcaggctatggacttggtattgggaatgtggaataagaagccaggccatcaggttagagaatatgagataaaaaatggttgtcaggagaaagagaaagttaaagtact

SEQ ID NO: 32514 - DNA, 360 bp, Homo sapiens
tggtactccctcccctttatgcttaatggatttatgtaattataaaacatataattaaagtcaattatgtgctaatactactttatattttgctaccaaatgcttttggctaccacatcaaaccctggagcttgacatatataaacctgctcctttcttaatttcattagctcctccacggtcccatcatgacctaagttgccaccttcccaggagacaaatacaaaccaatgtgtaaatgtgttttactcagctttctttatgttttccaaagctgaattgtagaaccgcatttatactctgtccttctctgtgtctcttttctctgttctcagtcttccattcattttttgtagaaat

SEQ ID NO: 32515 - DNA, 402 bp, Homo sapiens
cagcacagactctatcacaccatggaccttcaagggatagctctcttggcaaaacacccttttgccagacctaattgccagaagctgcagtggaaatgagaacccaggatatgggacgagacagacctatgtgtggatctcagctctgccatttgctagctgtgtggccctgacagtcacctgccttgtgagctctgagttccttaagtgtaaaaatgccatggtatggtagagaggaaagagactcatatttgaatatgacacagaataggcccttagtgccagcctcaggggctcacacctgtaatcccagcactttgggaggccaaggcaggcaggttgctgaagcccaggagttcgagaccaccctggtcagtgtgatgaaactccgtctctaaaaaa

SEQ ID NO: 32516 - DNA, 287 bp, Homo sapiens
gcagctagataggaaggaacggaggcatgagagcaaaaagtacctgccacaattcacttcaacccagtagcaaacattcgctttccctcctccccccactgtgagtcagcaaaatataagaggaaacaagagttcagttggtggggaaaaaaagtagaaatctttgtcagtgtcttatttttttctttttcttattttagtattaagattaagtcattgggcgtctctgtgagatataatgaagaaacatcaattagcaggtttctccattatatcatgagcggttc

SEQ ID NO: 32517 - DNA, 613 bp, Homo sapiens
atattcctgtgacccacctaccaactcccctagggctgtaggacagaggtgaaaggccatagattctattgtcctatgagcatgtccaagcacccagcactggaagaataacttgcggagttgatacaaggtttgatatgtttctcattctaaataaaatatatgtacacttttacactaactttgtatttctattgttggattatctttcttaaagaaaactcatccattgattgatggtgggaatgtaaactggagagcaaatttatcagaatttcaaacacatactcttttgacccaacaatccttccttctgaaattttatcttacagctgttctcatacatgtgcagaatgacttacaggctcattcttggcagcgttgtttgtaatagcaaacaactggaaataatccaactatctaagaacaggggactgattccataaaggatgacacactcataaaatggaataccatgcaattgttaagaataatgaggaagcgcttaaagaattgatctataaataccttctgataaagttgtatgtgaaaaaaagtcaaactacagaaaaatgtgtatagtatgcttccatatgtggttaaaaaaaaaaaa

SEQ ID NO: 32518 - DNA, 251 bp, Homo sapiens
gtggtagctcctgtcacacagtttcataaatgtttgtttacttcttcaagttaacgactcagtgtgcgctcctcaagcttagaaatgatggcctattcatcttcaaatcccaacctctagtgtcgcgtctggcccgcagaaggaaaatgaaggcctgactgcattgactttttggatgcatttcctagatgagtcctatttctaggtggcctcacaagaaataaaaacatgtccagcttgttccggatgct

SEQ ID NO: 32519 - DNA, 395 bp, Homo sapiens
ctataattatggaaagaatgaaaacatgttaaagagcgtatacagcttgaataaattgtttaaagcaatgatctggtataagaataataaggtacactcttcttcatatcctgtatgcatatttttcatataaaataagaacattttgctactaagatttctaaaaataataacaccttgataatagatacatctgatctataaactctgcctttaaactcactatacaacgtgataaaattgcatgaaactaaatccatgtgtgtatacatgcacacaaacacccatacacagagtacttgcaaaactaagaaaatctgaataacatcagtggattatatccatatcctggttgtgaatatagttttgcgagatgttatcagtgagagaaactg

SEQ ID NO: 32520 - DNA, 338 bp, Homo sapiens
tttgtatttttagtagagatggggttttgccatgttggccaggttggtctcaaactcctggcctcaagtgatcccaccccgcctcggcctccccaaagtggtgggattcccagatgtgagccactgcgccctggtcctaaaatattttaaaaaccacatattccccatgcacatttttaggttgacttaaaattttttgttaaagtttaaatagttgtaaaagatgtcatttctgggcatatataatgacatttttaagtgaaatggttacatcattattctaattgcatcccatgtaaccttaatacaaaaatgatttaataccaccaccatccatt

SEQ ID NO: 32521 - DNA, 1505 bp, Homo sapiens
atttaactaatatatgttgaattccttaacccatttatgccagaggttgcaatattttgaatttttgcatgagttaaaaattagaccttggcaatgaccttgaacagtaggatataaataactctcacgtgcttagtattccaataatggaacactaggcataagtgggtcaatatattcaaataagatttaaacaaaataaatgaatgttgctagtcattttttttttttttctgaaatgcacttattgactaaagatttgccctgggaaatacatttctttgggattagtcaaaattacaatccagtcttgactctataatttataaactgttattttatttctctcatattgagcttcccagggaggaaggtaaactccctatctctaaggactgttacgcttaaataaaccatagtttatgtgaatatccagcacagtgccactgcacagaatttattcaataaattacacttcccttccagagcatcaaaatctacattttctggccaggcacggtggctcaggcctgtaatcccagcactttgggaggctgaggtgggcggattagttgaggtcaggagttcgagaccagcctggccaacatggtgaaatatataatatatagacacacgtgcacatgcgtatataatctagaataaggactacgttgttatagtaaaggaggaaaagtgaaaaatgtcatttctacacagccaaagcattagaccctgtcttgtagattcatcctttgaactctttcatttgaaaaattacccagttcttaacctgataatggatgagaaaaataatcccttgcctttctccaccaaagacctaaagataaatattgcttttctaaaaaattaaaaataaatcttaaaaaatctcaaattttctatctggcttcatcttgttcatgtcgaaaacacaacagtggggtgtcagcaaagctgtaatacctgagaataaaagcgtagtgccaatacgcatgaacagaaattctgttcagacatgctgaagccttctgcagaaactaacagaatccaactggcttcattaatttcagccatctacatctttttcttcttatataaacaattaatgttttggttttcctttctaaagaaaatcatgtggagattttattcattctccctaagcctacttactgtcaaattgacacatggcttaagtgaatagaacctccaatttccttttttgttcaagagctactgttaggtaggagaagtatatctgaatccttgcaaaaaaaagaaaacttcaaaaggaaatttttaagagaaaaagaaggtaagtacatgtgtaacctccgtttcagacgcattacctattgtatcgttttctttgcagtattgtaaagcatgaaaaaaataggaattaagatgtcaaaaaagaattttccttttttaaaagtctgagctggaagggataggaattcttaaatccaaaaaaacaaaacaagaacacatacacaaacaca

SEQ ID NO: 32522 - DNA, 667 bp, Homo sapiens
cccaggctggagagcaatggcgcaatcttggctcaccacaacctccgcctcctgggttcaagcaattcttctgccccagcctcccgaggagctgggattacaagcatgtgccaccacgcctggctaattttgtatttttagtagacacggggtttctccatgttggtcaggctggtctcaaactccggaccttaggtgatctgcccgcctcagcctcccaaagtgctgggattataggcgtgagccaccatgcccatccttatgtaagaactattatagctccgttccacagatgaggaaaccagggaccagaggaattgttgtgcaaagtcacggctaggaagtggaggagaaaccgggactcaaacccaggccacccagtggcctagtctgcactgtcaccacagcactccactgcttccctcctttgtagctgggagaagatggaatttagtaactggagaggtgactgggatgaggtgcagctctagaagctgcaccagaatctggggcctgccatgagtcactcaacttctcatcctgttttcctgtctgtaatcatattcatacccacctaagcaaagcctttagatgagaaatagatgagatgatgaatggaaacaactagtcatgaattttaaatatattattaataataatatatata

SEQ ID NO: 32523 - DNA, 1078 bp, Homo sapiens
cccaggctggagagcaatggcgcaatcttggctcaccacaacctccgcctcctgggttcaagcaattcttctgccccagcctcccgaggagctgggattacaagcatgtgccaccacgcctggctaattttgtatttttagtagacacggggtttctccatgttggtcaggctggtctcaaactccggaccttaggtgatctgcccgcctcagcctcccaaagtgctgggattataggcgtgagccaccatgcccatccttatgtaagaactattatagctccgttccacagatgaggaaaccagggaccagaggaattgttgtgcaaagtcacggctaggaagtggaggagaaaccgggactcaaacccaggccacccagtggcctagtctgcactgtcaccacagcactccactgcttccctcctttgtagctgggagaagatggaatttagtaactggagaggtgactgggatgaggtgcagctctagaagctgcaccagaactcacaggaccccagagctgccaagctagaatgccctcaaagggctcgtggttcaagccccagaggcgtcaccccatgggagtttcgctgaggagcctgtctcataggtggttctccctctgatctttcctgctgtccagtcatcctaatctgttgttcaggcactcccagggagagctttttcagccttaaccttggctttttgtcctgccttggcccaaatccacactcctagcctgactcctaccgtgttttcttctcctcctcctgctctcaagacattcaagattctgtgcccttgtcacctcgtctcctcactgggttctctcatttctgcaatgagtaagaaatgtgagtaggaagaagatgctctcggaaactcaagttcaaatattcctgtttctggttagctctggggcctgccatgagtcactcaacttctcatcctgttttcctgtctgtaatcatattcatacccacctaagcaaagcctttagatgagaaatagatgagatgatgaatggaaacaactagtcatgaattttaaatatattattaataataatatatata

SEQ ID NO: 32524 - DNA, 1013 bp, Homo sapiens
cttcttatccatgaacatggaatatctcttcatttgtttagttcttctttggggtctgtcatcagagttttatagttttccttatatagatcttgtacatattttgttttatacctaagtatttcattttttggatatgttaatataaataattttttttttattttcaaattccacttgttccttgcaggtatataggaaagcagttgatgtttgtatattaaccttgtagcctgtaaccttggtataatggcttataagttctgggacttttttttttttttttttcaattccttcacattttctccatcatgttgtctgtcaacaaagacagttttattttatgctttccaatctgtatactttttatttccttttcttattgaattagctaggacttccagtatgatatgatggaaaaggatgatgagagggaacatctttgcccgcttcctgatcttagtgggaaagctttaatttctgaccatcaattatgatgatagttgtaggtttttgatatatgttgtttatcaagttgaggaagcttcttactgttcctagttttctgagtgttttttgaaatgaacaggtgttggattttattaaatgccttttctgcatctgttgatgtgatcaggtgagtcttcttgaacctactgatgtgatgggtccatgttaattaattgatttaaaaaattatttattttgagacaagagtctcactttgtcacataggctggagtgcagtgggatgatcttggctcactgcagccttggcctcctgggcttaagcaatcctcctgtcttagtctcccaagtagcagggactacaggtgtgtgccatcatgcccggcgacagatttttgattattaaagcagccttggctgggcacagtggctcacacctgtaatctcaacactttgggaggccaaggcagacagatcacttgaggccaggagtttgagaccagcctgagtgacacagtgaaaccactttcttaactaaaaatac

SEQ ID NO: 32525 - DNA, 454 bp, Homo sapiens
ttccttctccagcccaactccaacctaggaggaagccttgcatgctgaattgccaagggcaaaattagaaagcactgtactcgagctgctacaagccatggaaaaatttcttctttgctgcttgggatgggctgagagaaaaagtggagagagggccccagaacgttactccagtgctgttttctgtcatcaggattggaacagaaaccctaagagtggagtaacaagcatccctcctgctatttgccagctttttcatctcttggtatattacagtgtgtgttccactggcattatgtaagttgattttaggtagcatgatgacaggcatttttttaaaaagttttagtaatatatatgttgtaatcagaaaaatatgtaacattgtttatcatgagtaaaaaattgagcgaaagattttaaaagtatacacaatatttaaggaaaaatatta

SEQ ID NO: 32526 - DNA, 206 bp, Homo sapiens
aaccctctgccagcccttcctcagcctccaggcctctgtggtcagcctcgttctggtttttttctgccccttgaaggctgaggcagtgtctttagtgttgctgcagccttctccaagaataggcattgctcggttaactgaatcaatgtaagcatctccatgaacggtgcaaatataatgagcagaaagacctttgtcctcaggga

SEQ ID NO: 32527 - DNA, 339 bp, Homo sapiens
gataatgacctctagctccatccatgttgctacaaaggatatgatttcactcatttttttgactgtgtattataccatgctatgtatataccctattttaaaaaatccaatccactgttgatgaacacctagattgattccatgttttgctattgtgaatagcgctgtgatgaacatgtgagtgcatgtgtctttttggtagaatggtttattttcctttagatatatactcagtaatgaagattgctgggttgaatggtaattttgttttaagttctttgagaaatcaccaaactacttttccacagtagctgaactaatttacattcacaccgacaa

SEQ ID NO: 32528 - DNA, 424 bp, Homo sapiens
tgggccccctaatccaatatgatttgtgtctttataaaaaagggaaatttgtgcacagagataacacaggggatatgccatatgaagatgaaggcagaattctacaagcccagggatgccaaagattgccagcaaaccaccagaagctaggagagaagtgtggattagattcttcctcacagccctcagaaggaaccagccctgccaagaacttgatctcagacttctagtctccagaactgtgagacagtgcattttgttttgtaagtcagccatatggtttgtggcactttgttatggcagccctaggagatgaagacaatatgcaacatggtatgtccattataggacactgtgggccataaatgtgttctttggcctgaagaaataaaacttggtggtccaagttgatgtcttaaacatc

SEQ ID NO: 32529 - DNA, 484 bp, Homo sapiens
  misc_feature (26)..(26): n is a, c, g, or t
  misc_feature (54)..(54): n is a, c, g, or t
aatttggacccgaatccacccattgngcgttttctggtgcgggtggagagaatntttgaggtccccaggagagcctgcttgcagggaagagacgcctcttcgggaaatttgtgcacagagataacacaggggatatgccatatgaagatgaaggcagaattctacaagcccagggatgccaaagattgccagcaaaccaccagaagctaggagagaagtgtggattagattcttcctcacagccctcagaaggaaccagccctgccaagaacttgatctcagacttctagtctccagaactgtgagacagtgcattttgttttgtaagtcagccatatggtttgtggcactttgttatggcagccctaggagatgaagacaatatgcaacatggtatgtccattataggacactgtgggccataaatgtgttctttggcctgaagaaataaaacttggtggtccaagttgatgtcttaaacatc

SEQ ID NO: 32530 - DNA, 493 bp, Homo sapiens
gcaaatgcaaataaaaaaagatacaagtggaatttaaagttaaaagcactaaacaggacaaataagaacattatataattgtaaaaatcaagactctaataaacataaacataaacctttgttcagtaaacaacatagcagctaaagagagtggaaggaggtcattgatttataaacagaaattattgggtgaggttttaggaaagatatgtaaagaaggctgactcaactggaaaatgtcttttgccccttccctttcttatttcttctgtccataatgttggatatgatggccgaaattgcaacagccatcttgtggccatgaagcaactttgaggatacaaagtagaattcaagattgcaaagctcaaaggaatccagattgttaatgacatcatagagctggcatatctttcctggactatctgttgccagatttgctttgtgtgtgtgagagagagaaaataaatctctttcttgttgaaattactgt

SEQ ID NO: 32531 - DNA, 665 bp, Homo sapiens
ccaatgtgacagtaagtgatctttcctttaaaccacagcgcttcttgtatgctccagccagtatttttccaaattgcgggtagccatgcgttgttgagtagtgagttctgggtactttgtatgtagtaaggatgagcagagttttcattacccggttgcaacgtaaaatgtatttctcactgtgggtccagagtttttaaaaagcatgaaagctcctgtgctagcacaatgccaagttctaaataacgtttattaaatggaattatagtattttattttcattttgtatttatttttgttttctagagctatcgcctccattcgtagctactggacagtagagaccataccatctttatttttccgattcccagtggagtgcttgtgatgatgtgggctcattcaatgtgtgtcaaataaaagtctgaatggatacatcaatggaagggataatatagctcagtgaatgtgcttgaaactaactgctgttctaactcctggtattcttctgattctactgtgagagctgacattgttcagttaatcgtttccaagggccctagtcccgcagacagtgagaccaagaataattcgcattcaggaagtaccacttgcccttagtcaatatggcatcctgaatgacttccggaaagggcaccgcaaaa

SEQ ID NO: 32532 - DNA, 438 bp, Homo sapiens
gtctcattattctggtaagtgtctgtctctcctgatgtcctctctgtgagttggggatcacgtttttgttcaccaccacatccctttagcttagcacatacttggcacttggttcaaagaaaattttttgagtgaaccatttgattttgttttttgttttatagagttgagaagttcttaggtagggagttgatagtatcacaaaattaatctgtatacccagaccttggtcccctggcagtttggttttcagccataactaaaacttagttatcccagaacagttttaacacttcttcattttttgttggggttcttttgaaagttaatttagactttgcaatacgcggtaacctgggctttcgttaagaggaaccaagcaggccaagtagctttttatcattccattgaacacggcgatacaagatgagcagataa

SEQ ID NO: 32533 - DNA, 733 bp, Homo sapiens
atattatctaggaaactttatctggtgtattatataatatcaaataaaatcattttgcttacagtcttttagatactccacttttctataaaacagtggtatgtgtttataaatagctgaattataaaatgagtttatctgtagcctattgaaaggatggccaaaaaagttattttccaatgaaattagatctagtaaagtaaactacttagttgagatataagcagtatataaagcacaataaaatgccacttttcatattttcttaaattgcttttaggaattttagtggtgactagtctgccattctatttcatttctgtaactgaagcagcgcagaaatcttctattttcttttttctccctttgcttgaatagtaaatggttatagcactttttctacttcgatagaatgaatggttataatgaaaaaagcttttgatgaatggcactcttggatttgttcttaattttggcaaagacgtatataattctgcaaaagactttctctgcctcttcctttagtgagagaaaaaaaaaggtaggaatgacaacttaactcctaggattctgaggatctgcttatacaaataagaagtgctaagtaaaaactctgaaaatgttgctaactggtagagaaatggagattaacactttgttaatggaaacctccaaataaaggaattataattgtttaataataaagactatattttaaaagtgaacaaaaaaa

SEQ ID NO: 32534 - DNA, 1456 bp, Homo sapiens
attgattaaaaggtgacctttcttattggactgataagacaaaaatatagattccaaatctattgacatatgatatcacatccacaaatgtttgcctatttttgtagcattattttggttgcaaagtctcttagggaatgcacaaaaataatacaaccttaaaaatcagactagaagatggaatataagtggtttccttgtaatttttttttaagcttggagaggtaataacacatctttgaattcaaactgaggactgctgcttaatggtgcttttacagggtggttctaaaatttttgagagtcaggtattgctttctctgactgtttaattcaccactggcacgtgtttcctatcctcaagcataagtttaaaagattacaaacctcatgctgctcagttttttctttccagtaaatcagatgcatggtttctctagatttacatatagaaaatcgagatgtggtgggtattagactaacacttcagtgataggaagaagagactgatttctcatatttgtgtaaaacattctcttacctaactaccatctggtccacattaatttcctctcatagccatagctttccattaccaatgagttttccatgtattcacagcatatgggccaggaaatctttctacagagaatgtgtcccttaggcatatatttcccctagattaccgtattaagaaatgttctccctaaaccatacttatggcattaccataaaattgcctcttgaacacagttaaattgaaagtgctcaaaatgcatatcaattcaggtaaaagaaatcttgctacttggaggggaggtattttttattcttccccactttctctttctaactccctacaaagctatttctaattatttgcttatgctgggcactgaattttctcttaggctgaccatatattttattaaagtagtcttgaattcaggagtggaaaaaaaaaagttatgttttagacctcaatgtaagctgaaaggaaataaaggaacttctatatttccatttctcaggctgattttccttcccctgttctcttatctgtatcatgacatgagacgtgaacctcagaaatgtaaaaacaaaaagtctagaataaagcattcccttgaattttaaatgaacatgcttttagcagctggatacgaagcagactattttcaacaaattgaatgtttccccacttgtgtgagagccaaacaagtgccatacagaaagggacctcttcaatgttaccaaagctttgtggcagcatttaagtgtggtggctccatagaagtcactatagcatggacgagccacttggcttgctttttcctgctaatcaaagttttaagaagataaaaagctatctttgttatatatgttttgtctaatttgcaatattacagtctcctggggggaaatccaacttccaataataattgtaaaaaaaaaa

SEQ ID NO: 32535 - DNA, 1950 bp, Homo sapiens
tcaaaggtgccaaagtatatgtgctcgcaaaatgcaaagaaaggtgacaaaaggaaatttgaattgggaacaagggtccatgcttttcaaagtattaaaaagttttttgccaggcaaaaatcacttactttacctttttaagaaaatttgtcattattttccccagatttcagcatttttcccaatttttatttgtggagcatctcaggcaagccccctttcctggagcagcgtgcagagaccactggcacttgactttatttcttccttgctccattgctgaacagaaatgtcgtgggctccacttcctgttgtctttaagctcttagtcccctccacgtatacctatctgtactatgcataaccatatgtagaaaaggttcagttccttttagtaggtagtcctggatttaatgctgacctaaaagtaatgtcgacaatgctgtcaggtagctgccgttctaccgactccctccatccctgcccacccactgccctcccgagaatatgctggctgcccagtgcagcccgggagacacaggggccttccagaggtagggtctaccaggtcccgtacaacccctgggctgtcaccgggggtcaacagctgctgctcctatatacccaaacacctgacagctccctggggagcagatggctgagaagggtgctgaggaagccatattgggaccagccacagccacacacatggagcctcatacttaggagcgtgctgcctttaaatgaaggtggtcggggccagtgcagcggctcacacccataatcccaacactttggaaagccaaggtgggaggatctcttgaacccaggagtttgagaccagcttgggcaacatagggagaccctgtctctacagaaactttaaaaattaggcaggcatgatggtgcacacctgtggtcccagctactcaagaggctgaaggaggatcacttgagtccagaaggtcgaggctgcagtgagctgtgatcatgccactgcactccagcctaagtgacagtgcggtaccctgtctcaaaaaaaaaaaaaaaaaaaaaaaaaaagaggttggagcaggaggaagcataggggcgggaacagccacctcctccatgccctagattgtgaatttatcgggcagccaacacatgtatgacacactaggccctgtattacagcttgttacacatttcataaaagggattttcattaaggagataatctattactacctaccttagtggctactagtataaaactatgacagatttagcaattaaatgaaatactggcctccatcaaataatcatagtaacaagaagcagcagttaccagacatctgatccccttcccccaaaatacccaaattcttcatggttctgcccttctctgtcctttctgctccccttgctcgcctgggaaatggaggaaaggccttccctctcacactgtcttgggatcttgctgagaattcagactgctcgaaacagtgacaaaccccagccatccagtcattcgtggagcacaatttggatgtggccccaggggcatctgtcccattcagagaaccttggcagtgcgatggccactgttcccaggcttcaacctcagtgaccccccccaacaactccccatggagagtccctgcccaaaaaagctgtaggatccaaggggtgtcaatagctcgttcccggcatcacctacacaccacaagcaggttttaatggaagcaagttgctccaccaaatccacaaaagggtaaagtttgtgatttttctttatcattgcgatcaccatctgaacgtaaggagtgcacttgtttggaagttctgacttctctgatctgtcttggtcgtttgtgttataaaaccaaagttctctacagactttatttttgtacaatatcattttgtaactttttacaaataaaaactcatttctattgaaaactg

SEQ ID NO: 32536 - DNA, 1449 bp, Homo sapiens
tcaaaggtgccaaagtatatgtgctcgcaaaatgcaaagaaaggtgacaaaaggaaatttgaattgggaacaagggtccatgcttttcaaagtattaaaaagttttttgccaggcaaaaatcacttactttacctttttaagaaaatttgtcattattttccccagatttcagcatttttcccaatttttatttgtggagcatctcaggcaagccccctttcctggagcagcgtgcagagaccactggcacttgactttatttcttccttgctccattgctgaacagaaatgtcgtgggctccacttcctgttgtctttaagctcttagtcccctccacgtatacctatctgtactatgcataaccatatgtagaaaaggttcagttccttttagtaggtagtcctggatttaatgctgacctaaaagtaatgtcgacaatgctgtcaggtagctgccgttctaccgactccctccatccctgcccacccactgccctcccgagaatatgctggctgcccagtgcagcccgggagacacaggggccttccagaggtagggtctaccaggtcccgtacaacccctgggctgtcaccgggggtcaacagctgctgctcctatatacccaaacacctgacagctccctggggagcagatggctgagaagggtgctgaggaagccatattgggaccagccacagccacacacatggagcctcatacttaggagcgtgctgcctttaaatgaaggtggtcggggccagtgcagcggctcacacccataatcccaacactttggaaagccaaggtgggaggatctcttgaacccaggagtttgagaccagcttgggcaacatagggagaccctgtctctacagaaactttaaaaattaggcaggcatgatggtgcacacctgtggtcccagctactcaagaggctgaaggaggatcacttgagtccagaaggtcgaggctgcagtgagctgtgatcatgccactgcactccagcctaagtgacagtgcggtaccctgtctcaaaaaaaaaaaaaaaaaaaaaaaaagggggtggggccggggggaacattggggggggaaaaggaccccccctcaggcccaaaatgggggatttttttgggcgccactttttttgcccttgggccctgtttacagcgtgggacccttttctaagggggttcctgaggggatactttgctacccacctgggggcttgttaaacttgacatttagcttatgaattgggcccctattatcctggtacggagcgcgctccgaattggtcctccccacaaccatttgggtcgcctggcttggcccgtccgaaggggagggcgcccagtggcctcgacaagcgccggaacccccctgcaagtgcgctcccacggggcgtctccccccgcgcgcggcgccctgtcgcgtgcggatggcgccg

SEQ ID NO: 32537 - DNA, 947 bp, Homo sapiens
tcggtaaccccgttgactttagaggattccccgtttccaaaaaaaaaaaaaaaaaaaaagaggttggagcaggaggaagcataggggcgggaacagccacctcctccatgccctagattgtgaatttatcgggcagccaacacatgtatgacacactaggccctgtattacagcttgttacacatttcataaaagggattttcattaaggagataatctattactacctaccttagtggctactagtataaaactatgacagatttagcaattaaatgaaatactggcctccatcaaataatcatagtaacaagaagcagcagttaccagacatctgatccccttcccccaaaatacccaaattcttcatggttctgcccttctctgtcctttctgctccccttgctcgcctgggaaatggaggaaaggccttccctctcacactgtcttgggatcttgctgagaattcagactgctcgaaacagtgacaaaccccagccatccagtcattcgtggagcacaatttggatgtggccccaggggcatctgtcccattcagagaaccttggcagtgcgatggccactgttcccaggcttcaacctcagtgaccccccccaacaactccccatggagagtccctgcccaaaaaagctgtaggatccaaggggtgtcaatagctcgttcccggcatcacctacacaccacaagcaggttttaatggaagcaagttgctccaccaaatccacaaaagggtaaagtttgtgatttttctttatcattgcgatcaccatctgaacgtaaggagtgcacttgtttggaagttctgacttctctgatctgtcttggtcgtttgtgttataaaaccaaagttctctacagactttatttttgtacaatatcattttgtaactttttacaaataaaaactcatttctattgaaaactg

SEQ ID NO: 32538 - DNA, 397 bp, Homo sapiens
aatagggtttcaccctgtcattgtcgtccttgttttctgagacagagtttttctctgtcgcccaggctggagtgcagtaacgtgatctagacccactgcaacctccgtcttcttggttcaagcgattctcctgcctcagcctcttgagtagctgggactacaagcacctgccaccacaccggctaatttttgtatttttagtggagatgaggtttcaccctgttgcccaggctggtcgcgaactcctgacctcaagtgatctgctgccctcagccttagagaataaacaactacataaccaccaagcaagcagctcaagaaacagaataagataagggcggtgagttaccagttccattcagtctgtgttggtcctagtcagtacagtaagacgtga

SEQ ID NO: 32539 - DNA, 342 bp, Homo sapiens
tataagggccagttcttgacatttaaatacttactgtatgtttaaagtatgctgtcaaacctactataaagcaacagtagtatataggggctgttatgttccctaaagaatggaatttttcatttactaagtcagccatagccttgccagacacctagagaatgaagcatctcttttggtggctcggttaatgtcctttgtggaaggagccagatggagtcgactgtgtgaagttagataaggcctaggtgcctaagaagtgggaccaagaccaagagaaagaaggaagtaggatgacagtttggtatgggaactaagataaccagtaggatggctgtgtag

SEQ ID NO: 32540 - DNA, 522 bp, Homo sapiens
cttaggatgtctttagttattttacatatttataacacagaaaaaaagtaagaagaaaaggaaaaatggtgtataatcttaagaccaggagataaccaataataaatattttgctataatttcttttcatattctatgcatatacattttatggaattgagttcacactgttcacataattttgctttctctattttgcctttacctttatcaataagcattttctttatatccttaaaatttctttattaacgtaacctaatacatatgcacaaaatgttacctaatcattcgcctgtttaagggcatttggtaatttccaatattttttccttcacgatttcgggtaatgtttaaataaaccaatttatggaaaagagctacctatgttggattacttgcttagaatgaattcctggaaatagaattactgggtcaaagggtaccaacatatttaatgtccccaaaggcatattggcaaattgccttccatacaaattataccaattccccctctgtaac

SEQ ID NO: 32541 - DNA, 350 bp, Homo sapiens
aatattactttcccttttaactttttattttgaagatttaaaaatatatagaaaagctgaatgtattgtgttcatgagcacaaaaatatccttaacattttgtcacatttgctttacatatatttaaaaattttattttgtgacctgatctcactctgttgcttaggctggagtggatcaaagcttggtgcagcctctaactcctgggctcaagcaatcctcctgaatgagcctcccaggtagctgggagactgaggtgggaggatcgctatctctaagttcttgagcctgggaggtgggggttgcagtgagctaagattgtgctaaaagtgacagaatgagatcctgcc

SEQ ID NO: 32542 - DNA, 408 bp, Homo sapiens
gtaagtttccaccttttacattaacagaatgaattgtgttcttctattgaaaccctgactggaagaggggttagagaatagatactgtttgtgggtgagaattgtattatttagaactttgcaattggctgggcacggtggctcatgcctgtaatcccagcactttgggaggccaaggcaggcagatcacccaaggtcaggagtttgagaccagcctggccaacatggtgaaaccctgtctctactaaaaatacaaaattagctgggcgtggtggtgcgtgcctgtcatgtcagctacttgggaggctgagccaagagaatcgcttgaacctgggaggtggaggttgcagtgagctgagattgagccactgcacttcagcctgggtgatagagcaagaccttgtctcc

SEQ ID NO: 32543 - DNA, 398 bp, Homo sapiens
ggacctcaaaaggaaagaattctgtgacttagatgaagcaacaaccccacagcatttgttacccacagaggtaagccaggactcagctttgtgctacaaaatccagaccatgtgcaagacggtcctgaaaggatatatggccccgaaagagagaaaagatgaaactccaacccgtgctttcattaggatgggtaggtttaatccaataagagatcacggtcagggtgccatgttggcttggtctctaaatccatcaggatgtgccctttccaccttcagttttccccacacagggtgggtgatgggtcacttaaagtttttgattcccagtccttcatggggagttcccgagggaaataagggcagggctcgtgacgtcctcgtacccttgttgtaca

SEQ ID NO: 32544 - DNA, 748 bp, Homo sapiens
tttaattattcctcatattcacaaccacttaaacatttaatagagtttttaaaaatccaaacaatgtgtatcttgtataattttattttcatttaaaattctattaccaaaaaagccaggttagccatttgcttataataaatcatgccttcttttaggaatttttagagtcagtttaatgggactcctgagttgacagctgtgcagtctgaattgccttagactctgaaaatgcttcagatttaaaatactaccaaccaacatggagtactgatcttcccacttgttgccaaagaggctagttaggaaaactagggacaggctgttctcttgcaattcaaaactgaacataaactgaaattgagagaaagtcatattaaatcctcatgtctgccatgtttgcagaggtcagctatacaaatatgaatgttaatttgaacttcaagaaaaggacactgctaaaatataatacatcttgaaaatgaagatgactctctacttgttttaatcagaacctcactgatatgtctcagggattaatttcatatatcatatccttaggctgagtgtgttggctcacacctctaatcctagcactttgggatgctgaggtaggagaattgtttcaggacaggagtttcagaccagcctggtcaacatggtgagctctcatctcaaaaagaaaaagaaaaaaagacccttcaagaactcagttttgtggtattaaaaactgagagagagatgttta

SEQ ID NO: 32545 - DNA, 698 bp, Homo sapiens
ctgttagtggattagcgagctcggtaatccggtctcctaaatgaacaaaaaagtagacgctttttgaggttgagcatatttcgattaaatcttggcttaggccctagatcaagggtttagatcagaataaaatgaaaattagtgttgcacgtacgcatattgcatcagaatcttgcagtgattgttttagtttcctgagttgcattgatagattcttttaaaatatgactgatttgcataactttagaagcagaatcattttcagtatatatggtgcacattgagggcaaaaagtagttttgttaatgtttaaacttaagttacctacaactttgaactgtatgtagaagttttgtagtttgaagtcaatagtgccataatataccttataaggcgttcttactagatctttgttatatttacctttttctctccctatggggtgatgtaggatagtgcttgaaatttgcacttcagtagcatttaatgttcagtgctcttgtcataaacatagaatggatattgagtagtttctgatcccagatggtaatgtgtaggttcaagggtattgtgtgtagcaagtgaagattgcagaaataaaacttcagttcatgcttgaaatttaagtattgttgtgatgccagaattgctgctcaccgtttttaggtttcaggtcctctgacaccttttggtatcgt

SEQ ID NO: 32546 - DNA, 421 bp, Homo sapiens
ttctgcagctgctctggtgggggagtgggaggccccaatcttggcaaaatagtgatatgggttttaatgcacacccagggcccaaagatgagggtttctgtttatgaatggtgaggagttagaaccaaaactatatacagccagggcccacaaagggctatacccttactaaaaagataggccagaaaaatatctttctactagcataggaagacaacagggagactgttcttgcctgagcatggaaagaagaaaaatgtctcctatgaagtcatgtgtgagctgggtctgtgcctcactccaatttgctatttatgtggtctatggggttagaaactctcaaccggtgacaccgctagtaaactagattttttcttaaaaaaaaagaaaatcttgcgggagggatataccttcagcccag

SEQ ID NO: 32547 - DNA, 344 bp, Homo sapiens
ttcagcttaagcccaggcccatcgttcacactctttgctgactctgccctctgagagttcttcctccgcccgcattttgtgtctttctagtgctgtgggttcccgggctgctttacatttgtttccacatattcctccatctgcattgcaagctctctgtgagaaagagctaaatctcatcagctttttgtgggggatggggacagggattctgtaaggtgtgtaggccagggactggggtaccaagggggggattgttgatggcaaggcacagcccccacttccttgctcaatgattttaccactccttggctggtctaggtttctttttctttttcttttct

SEQ ID NO: 32548 - DNA, 1248 bp, Homo sapiens
ctgataaggtctgttaggttagatataattgctattttattttaaatcacagcaaagttatttgtgttcacccttgggtttatttagaaaatacaaggttacaaagggcttccaaagatcattattagcagtaagaagattaccgaggaaaggaaaagtggtaaggaagtgggaagaaaaccgaagactgatgactgaataagatcttacatatttgcatagctcagaaatttgaatactatatccaggagtctatttttttttcaacttgtaaaaaatggtagtaaaatacaaaaaacataaaatgttctatcttaaccatttttaggagcacagttcagtgttattaaatatattcacaatgttgtgcaaccattaccaccatccatctccataactctgttcatcttataaaactgaaactatggccgttttaagtccccattgcccttcttcccagtaaccactattctattttgtctccatgattttggttactctatatacttcatgtcagtggaattacacagtatttatatttttgtggctgggttatttcacttagcataagtccttaggattcatgtaatgtgtagtatatatcagaatttccttcctttttaaggctaaataataatccagtgaatggaaatagcacattatgctaaagtattcactgctgatggacatttaggttgctacattttagctactatgaattatcattcagccaagcactgtggctcatgcttgcagtcccagctatgcaagaggttaaagcaggaagatcgcttgagtccaggatttcaaggccagcttgggcaacacagtgagacctcatctcttaaaactgtaataggcccacttgctccctcctgccatctggctgacatgaagaactggaggtggcagcagtggtagcctgcatctgaggctcatgggctgcaagcccctgctcgtgcaccatggatgattttgccaaagaaagtttcactgtagtggattatgtcttgttagaaaattgccctaatatgggtgactatgtcgttgctcctcaatttatgaccgacaattatgttcgtgtgactcagcttaactgggatggggtgggtacgcaataaaaagattacatctaagtgagagaaatttagcaattcttgtggttctgagataagtttgaagaaatcacaacatcttgagttgatagaagatactgtggatttggcaaagaaagttgctgtaagtggt

SEQ ID NO: 32549 - DNA, 929 bp, Homo sapiens
  misc_feature (512)..(512): n is a, c, g, or t
tgctatttcaaaacaattgactttaaaaaattatacttcacccacagagacaggtgttgttttgtaatggaaggagtagtaacttatgaatctagactcttaaaatcccagttctgatactttcataattgtgtgttttgagggcaagtgacttatctgaacttttttcttttttataacactggatgataattaaccctcaggattgtgaggatttaataactaagtcctgactcaaattatgttaccaataaatgctacttaaatgtaaagtccttgatttattttttcccctcagtcctgtttagtgttgaaattcttcaaaggagggtgagtctgggcatttacctgctattcaagagttttcaggaattcaaccccagccaaaatttttgggcccacatctcttgtcactggctttgctgtggtactaaagctccccaggacacacaaggaatcttctaggtcatgggtcaaactttttctgcaaaggggcacttacagtctattgncatattctttgtttttaagtgttcaagacatctgctgtttcctgaaatatgtccgtgtattttcaattccctttttcctgccctccctgggcatctcccagtttccctactgatgtgtcaaaactgagtttgtatgctacctcccaggaaagcagtctaatcttttgcaactctgttactgacttttgtggcattggattgggttatttgcttatggttgagacatcactggatcctttgatggattcataccaaaaccacaacatgtcatgagcatgcttgagagtgcatttgattccttgtttgtcagaccagtacattacagttggttcatttcttcccccgtgtgactgagtttcttgagggcgcggtctagcttccatctttgtatgtgtagcacctggtacatagagaaca

SEQ ID NO: 32550 - DNA, 551 bp, Homo sapiens
gtctgccctctctgctcgccctgcctagcttgaggatctgtcaccccagccatgaggattatcgccctcctcgctgctattctcttggtagccctccaggtccgggcaggcccactccaggcaagaggtgatgaggctccaggccaggagcagcgtgggccagaagaccaggacatatctatttcctttgcatgggataaaagctctgctcttcaggtttcaggctcaacaaggggcatggtctgctcttgcagattagtattctgccggcgaacagaacttcgtgttgggaactgcctcattggtggtgtgagtttcacatactgctgcacgcgtgtcgattaacgttctgctgtccaagagaatgtcatgctgggaacgccatcatcggtggtgttagcttcacatgcttctgcagctgagcttgcagaatagagaaaaatgagctcataatttgctttgagagctacaggaaatggttgtttctcctatactttgtccttaacatctttcttgatcctaaatatatatctcgtaacaagatgtctttg

SEQ ID NO: 32551 - DNA, 5090 bp, Homo sapiens
tccgcaattcgcctctgccacaggctgcaaaggacccgaggaaccgctctctctgaactgtgctgatgggcaggaggatgggagacaggaattgagagtcacagaggaaggacagtggagtctggcatcttattggtgtctttaaaggattgccatttaatgccattcaagatctactaagcatcatttttgcatgactactgcaaaaggattactttacagataccagttcctttgtcaagagcatactttggaccctgttttcagaaagcagggcactctttaatgaagaaacaccagagctgttaaacacattgagacacagaagattctagtgactgaggatggcttcctcttggaaactaatgctgtttctgtcagtcaccatgtgtctttcagaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagataagtacacaaaaattttcttgaaaaatattgtatgattgcatagtgaaatagcaagatttgtcaatatgctattctatatgcacccctagagcaagtcattagggtagggaataagccatttacattagtgcaagatagaaagcgagtccagatgaatttcagtgctatagtttttcataaagtactatgttatctagcagcaaatataataaatatttatttttaataacaaaagatggtttaacatcaccaaaaaatatgatcactaaaaactgcagacatgctggcatgggtgctaacttaaaaatgagatgaatatgggacagagcgtttccatttctttacctactgccaaaacagatgttgaattaggtccaaggttttcttctaattgcaaaattttgcaaaaattttaagggcaatgaaaatttgttgtgcaaataattatgcatagtctgtagattaaaatggttcaagtataacaaataagttttgatttttaaaaacagttccatgcatcacataccactgataaaatcaactagtaaaataaagacagtctttcttggataaattgaatttttaattaagctgtggaaacatggcatcagtacagggattcagctagtctagccagctatgcactgtttgattctgtggcttgggaagtaatccttatttgctatttcaaagagtcatcttgagcctgagagatcctagagagttgttggaaaatgagatgaaaattttctacttgatgatatcttaaagaagttctaacaagcacaagaatgtgccagagttggcatcatacccatgaagatgcgtgaaaggatagttattgcaaagtcatatgccagagaagagcctggagaaactatggttttataggcgatgttaacaagagaacaaaaattggttttataattttatataatttaaacttgttaactgtatttgcttcattaataacaagcaaaatgaaacaatatggagctcaaattgctagctctcaaggttaatccttgtagaatcagagaagtgattgaagtttctgttctgaacatcctgaaagaatagtttcagagccacagtaaaagtctgtatgtaggttacatattctctttggggaaatgatgtaag

SEQ ID NO: 32552 - DNA, 2420 bp, Homo sapiens
tccgcaattcgcctctgccacaggctgcaaaggacccgaggaaccgctctctctgaactgtgctgatgggcaggaggatgggagacaggaattgagagtcacagaggaaggacagtggagtctggcatcttattggtgtctttaaaggattgccatttaatgccattcaagatctactaagcatcatttttgcatgactactgcaaaaggattactttacagataccagttcctttgtcaagagcatactttggaccctgttttcagaaagcagggcactctttaatgaagaaacaccagagctgttaaacacattgagacacagaagattctagtgactgaggatggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaaggttagaatctattttataattcaagttcaacattagacttttttgaggttacaggtgacacacacaaactatgcaagaaagagtcttgcagtaccgtgagacgtattttatgaactgattgaaacatggttttgcctatatagtgattttaaaagaacccaaagtttgacttcaaaatggtcagtcttctttgactccatggggttttagcataagttggatatttcactaggttttgaagaaagtactctttaattaaactaattatttttgtttgtttttcatcttgcttctgcatttaggaggtctacaaatcatctgtgataatttttaagcattgtgttttaatttgattttaatacaaatgataaaaacatatgtgaatcttctggataatcatgacagaatactttcatgtgatatttatgccaatgcttgtctttttatccaggtcatatttaggcaaaatagtataggattatttttagtgccatag

SEQ ID NO: 32553 - DNA, 522 bp, Homo sapiens
tccgcaattcgcctctgccacaggctgcaaaggacccgaggaaccgctctctctgaactgtgctgatgggcaggaggatgggagacaggaattgagagtcacagaggaaggacagtggagtctggcatcttattggtgtctttaaaggattgccatttaatgccattcaagatctactaagcatcatttttgcatgactactgcaaaaggattactttacagataccagttcctttgtcaagagcatactttggaccctgttttcagaaagcagggcactctttaatgaagaaacaccagagctgttaaacacattgagacacagaagattctagtgactgaggatggcttcctcttggaaactaatgctgtttctgtcagtcaccatgtgtctttcagcattactgtcttccctgctgatctcagttgtttctcttttatcttctcaatgtcattttcctcttgaacttataagccaactgaaggagatggaggtagggttgcaagatgaaataaaggaca

SEQ ID NO: 32554 - DNA, 5312 bp, Homo sapiens
tccgcaattcgcctctgccacaggctgcaaaggacccgaggaaccgctctctctgaactgtgctgatgggcaggaggatgggagacaggaattgagagtcacagaggaaggacagtggagtctggcatcttattggtgtctttaaaggattgccatttaatgccattcaagatctactaagcatcatttttgcatgactactgcaaaaggattactttacagataccagttcctttgtcaagagcatactttggaccctgttttcagaaagcagggcactctttaatgaagaaacaccagagctgttaaacacattgagacacagaagattctagtgactgaggatggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagataagtacacaaaaattttcttgaaaaatattgtatgattgcatagtgaaatagcaagatttgtcaatatgctattctatatgcacccctagagcaagtcattagggtagggaataagccatttacattagtgcaagatagaaagcgagtccagatgaatttcagtgctatagtttttcataaagtactatgttatctagcagcaaatataataaatatttatttttaataacaaaagatggtttaacatcaccaaaaaatatgatcactaaaaactgcagacatgctggcatgggtgctaacttaaaaatgagatgaatatgggacagagcgtttccatttctttacctactgccaaaacagatgttgaattaggtccaaggttttcttctaattgcaaaattttgcaaaaattttaagggcaatgaaaatttgttgtgcaaataattatgcatagtctgtagattaaaatggttcaagtataacaaataagttttgatttttaaaaacagttccatgcatcacataccactgataaaatcaactagtaaaataaagacagtctttcttggataaattgaatttttaattaagctgtggaaacatggcatcagtacagggattcagctagtctagccagctatgcactgtttgattctgtggcttgggaagtaatccttatttgctatttcaaagagtcatcttgagcctgagagatcctagagagttgttggaaaatgagatgaaaattttctacttgatgatatcttaaagaagttctaacaagcacaagaatgtgccagagttggcatcatacccatgaagatgcgtgaaaggatagttattgcaaagtcatatgccagagaagagcctggagaaactatggttttataggcgatgttaacaagagaacaaaaattggttttataattttatataatttaaacttgttaactgtatttgcttcattaataacaagcaaaatgaaacaatatggagctcaaattgctagctctcaaggttaatccttgtagaatcagagaagtgattgaagtttctgttctgaacatcctgaaagaatagtttcagagccacagtaaaagtctgtatgtaggttacatattctctttggggaaatgatgtaag

SEQ ID NO: 32555 - DNA, 1511 bp, Homo sapiens
tccgcaattcgcctctgccacaggctgcaaaggacccgaggaaccgctctctctgaactgtgctgatgggcaggaggatgggagacaggaattgagagtcacagaggaaggacagtggagtctggcatcttattggtgtctttaaaggattgccatttaatgccattcaagatctactaagcatcatttttgcatgactactgcaaaaggattactttacagataccagttcctttgtcaagagcatactttggaccctgttttcagaaagcagggcactctttaatgaagaaacaccagagctgttaaacacattgagacacagaagattctagtgactgaggatggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaataaatacataaaagggagtgtaaagaagactgcttcactcaagaaggtctctgtttatcacttggtgtcctttctaagaaatgtcacaattatggaaaaaagaaacatcttatgaagatgtctaccctctacctaaagaccaatctgccacccttatgaaaataaactactggcctcgttggcctca

SEQ ID NO: 32556 - DNA, 361 bp, Homo sapiens
cgctaatgggtcattatggctaaacatagtctatcactggcgttactcatggtattggaaggaacttgaattccatatagatagtgtgatggagaaagtattttgggcattggcagtattaattcaaagaacaaaggacctgtctgtcatgtgtggagagccgtttccgcttgtttctttaaacgctatgggaaaagcagtcggccccgtgcactctgctggacagcttcagtctccacgtattggtttggccaattgtcattcgctgtcatcatggcagcagcagttgaagggacagcttgtcttgatttgcatttttgggtgtttgtgctatttatagacaattaagaaaagacatgga

SEQ ID NO: 32557 - DNA, 1095 bp, Homo sapiens
tcccccccaaaaatacttttcttgcttaatttactttcttggtaagagtgaatagaggctaagtgataatgccactacactgattaaatgacttactggcacaaaactattgaggcttaactagttgactgttttaataacatcattaaaatttcattttggtttattagagcacatccatgcaaagttggaatctaaccattctcatgtctccttataatgcctaggggatctttgaaacagtatttttgccaactcatactttctattttcattctgtaaagataaaacatgtaagtgaaaacgtttaacaaacattaagaaccttcttcgaccaggcactctccttcgctacaaaatttccacattacctatttttttattagccatttttgaactctcttccatttctaagtttctccctgcagctttcctgaacatgaagcatttccttttcttttcatttctagctttcctttctctgtacctcatgtacacttggaagcttcagggacttagcactggtcatgccagcctctacagatcacatctctgtctataattgggtctccatggtaatgagaagcagaaagtgctgaagtagcgcactatgtaaggactggcaagagaaaatactgtcgcggcctctacaggcatagcattgaatccccatggtgcccaagaagcccgagagaagcacgctgtggtgtagagcaggagactgaggacacggacttggcagatttattagcagcaatattctaagatgaaccaaatttaagagtttgtaagtgctcttttcaattggaaaagacctttgaaatttttttttcttttcttttaggaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgcca

SEQ ID NO: 32558 - DNA, 863 bp, Homo sapiens
ggccccggaggcgggcacttggggggaaagttgagacgtgattaccgggttgggcgggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgagaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgcca

SEQ ID NO: 32559 - DNA, 947 bp, Homo sapiens
ggccccggaggcgggcacttggggggaaagttgagacgtgattaccgggttgggcgggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgagaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgccaaaaaaaacaggcaaaacaaagaaaccccccgggagagaccggcaaaagggcaggccccacaggcgggcgcggcccagtttgtcc

SEQ ID NO: 32560 - DNA, 488 bp, Homo sapiens
ttatttcgttcctactatctctctaaataatttaggatataaaattgactgaataaaaaccagtaagccaaggttttcacccttcgatttttataccagggcaagatggagaagtatctggaaagggactgtcccaggattactagcagaaagaagcaaatactcttatccccatagcccttatcatcaagctgaaaaataaagaacaaagcaacaagtaaacacacctatgaaagcaacttgtttgagctgtctcaacttctctgcagctgttctggctgtatctgtattctagtacttctttgaactctagagaaaagtttgttcatcaaaacctcatgaagtttaaaggtagtctattgccttttgtcctttttcaaaaatcttatttctttatttaaattgacaggtaaaaattgtatttttatgatgtacaacatgatgttttgatatatgaatacattgtggaatggccaaaccaagctatt

SEQ ID NO: 32561 - DNA, 409 bp, Homo sapiens
ggtacccactagtccacggttggctcaggtcacccggcagcagcagctctcgagagctgaggcacaaggcgggggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagaaactggcagacctttcacttcgtagccaaccgtggactagtagccaaccgtggactagtagccaaccgtggactagtagccaaccgtggactagtagccaaccgtgatagtagccaaccgtggactagt

SEQ ID NO: 32562 - DNA, 821 bp, Homo sapiens
ctctactgctacttgcccagcgtgcgccaccccgagaatggacgtcacattctggtctactgctaccactaccacaatgccgagcgaggaggcgggctctccggaagccgccgagtgattagtgccagctattcaacagaaaagaacggtggcttttctaaaccaatttgtggtgcacactgtacagttcctcaaccgcttttctacagtttgtgaggagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgagaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgcca

SEQ ID NO: 32563 - DNA, 983 bp, Homo sapiens
ggtacccactagtccacggttggctcaggtcacccggcagcagcagctctcgagagctgaggcacaaggcgggggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagacagggtctcactttgtcacccatgctggagtgtagtggagtgaacttagctcactgcagcctagacctcctgcctcagcgccccaagtagctggaactacagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgagaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgcca

SEQ ID NO: 32564 - DNA, 805 bp, Homo sapiens
ggccccggaggcgggcacttggggggaaagttgagacgtgattaccgggttgggcgggccccatctgggaggggtttgtgggtgaactcggggtccaccgcccgctgaggagatggatgaggacgggcttcctctcatggggtcaggcatagacctgaccaaggccagctattcaacagaaccgcttttctacagtttgtgaggaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgagaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgcca

SEQ ID NO: 32565 - DNA, 1364 bp, Homo sapiens
ggccccggaggcgggcacttggggggaaagttgagacgtgattaccgggttgggcgggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgagaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgccagtatgtcttgttgctaaaataaagggcctcaaaatgaaaaataggataccctaaataaagtacaattagtgctccaaatactaagatagaatattttagagatgcaatgagcaattacagtcaggcacggtggctcacgcctgtaatcccagcactttgggaggccgaggcgagtggataacctgaggtcaggagttcaagaccagcctggccaacatggtgaaacctccatctctactaaaaatacaaaaagtagctgggcgtggtgacaaaaattagctgggcgtagtggcaggtgcctgtaatcccagctactcgggaagctgaggcaggagaatcacttgaacccagaaggtaaaggtttcagtgagctgagattgcgtcattgcactccagccatggcgacaagagtgaaactctgtcttaaaaataaaaagagatgcaatgagcaattttaaatgaagtcagtgtgagtttagtgatcaatagtagacccaatgc

SEQ ID NO: 32566 - DNA, 949 bp, Homo sapiens
ggccccggaggcgggcacttggggggaaagttgagacgtgattaccgggttgggcgggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgaaaaaattaaaaaaagaaaaaaatgaagacagacaataacaagtgttgctgacggtgtggagaaattggaaccctcatacattgcaggaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgcca

SEQ ID NO: 32567 - DNA, 752 bp, Homo sapiens
ggccccggaggcgggcacttggggggaaagttgagacgtgattaccgggttgggcgggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagggtgtaccagtgatggcaataagaaacaaaatgatatcagaaggactagacccagatcttcttgagaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgcca

SEQ ID NO: 32568 - DNA, 1069 bp, Homo sapiens
ggtacccactagtccacggttggctcaggtcacccggcagcagcagctctcgagagctgaggcacaaggcgggggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagacagggtctcactttgtcacccatgctggagtgtagtggagtgaacttagctcactgcagcctagacctcctgcctcagcgccccaagtagctggaactacagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgaaaaaattaaaaaaagaaaaaaatgaagacagacaataacaagtgttgctgacggtgtggagaaattggaaccctcatacattgcaggaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgcca

SEQ ID NO: 32569 - DNA, 1105 bp, Homo sapiens
ctctactgctacttgcccagcgtgcgccaccccgagaatggacgtcacattctggtctactgctaccactaccacaatgccgagcgaggaggcgggctctccggaagccgccgagtgattagtgccagctattcaacagaaaagaacggtggcttttctaaaccaatttgtggtgcacactgtacagttcctcaaccgcttttctacagtttgtgaggagacagggtctcactttgtcacccatgctggagtgtagtggagtgaacttagctcactgcagcctagacctcctgcctcagcgccccaagtagctggaactacagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgaggtgaagtaagaacatttatgatcataatatgcagagccaaatttctgttccccttgaaaatatgaatatcccgcctggaaatgatggtattgctaaaaattaaaaaaagaaaaaaatgaagacagacaataacaagtgttgctgacggtgtggagaaattggaaccctcatacattgcaggaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgcca

SEQ ID NO: 32570 - DNA, 668 bp, Homo sapiens
ggtacccactagtccacggttggctcaggtcacccggcagcagcagctctcgagagctgaggcacaaggcgggggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagggcaagatggagaagtatctggaaagggactgtcccaggattactagcagaaagaagcaaatactcttatccccatagcccttatcatcaagctgaaaaataaagaacaaagcaacaagtaaacacacctatgaaagcaacttgtttgagctgtctcaacttctctgcagctgttctggctgtatctgtattctagtacttctttgaactctagagaaaagtttgttcatcaaaacctcatgaagtttaaaggtagtctattgccttttgtcctttttcaaaaatcttatttctttatttaaattgacaggtaaaaattgtatttttatgatgtacaacatgatgttttgatatatgaatacattgtggaatggccaaaccaagctatt

SEQ ID NO: 32571 - DNA, 541 bp, Homo sapiens
cgacacacgccggttgcgatagctagccctacctcttattcagcccccaagattttgtgtgtgtttatgtgtggtgctttttgcctgccaaaattcgtaccagtgagtctagagcctgttctcaaacttttgtgcacctctgtcatcttcggacaccccacccacagcttaggaaacaagttaatgactattcccagtccttcaagaaattcatatcacacagcaaagtgcctcgtgattatgtccaaatatgaaaagatttgcactgtgtacgttcctcctgtatgaaccatgtttgtttttacgtaacacaggtgccagctattcaacagaaaagaacggtggcttttctaaaccaatttgtggtgcacactgtacagttcctcaaccgcttttctacagtttgtgaggaggtaggtccggtgatactggtttatagagtcgcctggaaatcacctttcactgctgagactgacaaatggagtaaaacaagaattacagtctttattcatgtaccgtgacctctcatcacccaattgtg

SEQ ID NO: 32572 - DNA, 332 bp, Homo sapiens
aaatcaaaatctgccacgatttgaagcagccttcttgaaaataaaggttagtgggctgggcgctgtggctcacgcctgtaatcccaacactttgggaggccgaggcaggcggatcacgaggtcaggagtttgagagcagcctggccaatatggtgaaaccccgtctctactaaaaatacaaaaattagctgggcgtggtggcgtgcacctgtagtcccagctactcaggaggctgaggcagaagaatcgcttgaacctgggaggcagaggtggtagtgcagccgagatcgtgccactcgatccagcctcgggaccagagtaagattccatct

SEQ ID NO: 32573 - DNA, 432 bp, Homo sapiens
aaacacctcaaaggttattgaaattctgaatcattggatgcttggattctgccacaaaaaatggttggtcttgaaactaagatattagaccttatgatgccattttgaagctcactgtcttataaactgaggtgtcggctgcaaatgaggtgccagagatgtaacataattcttaatcatcatttctttttttgagacaagagtctcactctgtcgcccaggttaaagtgcagaggtatgatctcggctcactgcaacctccgcctcccgagttcaagcgattctcctgccccagcctcctgagtagctggaattacaggtgcctgctaccacgcccagctaatttttgtatgtttagtagagaccgggtttcaccatgttggccagactggtctcaaactcctgacctcaagtgatccatctacctccgcc

SEQ ID NO: 32574 - DNA, 390 bp, Homo sapiens
cacactctgaacaagagcaacctttccaccatgcagctccagtaatgctcccctgcacagaaaccctcagggactccccactgcacagaagggaatcatgcctttccaagaagaagcattcaaatcacatcaactatgtccaatgagcaacactgatatgactcccacgatatatactgaggagtttcatatatatttattcatttagatacatattattattactgttattatttttattgttatttttgagacagagtctcgctttgtcgcccaggctggaatgcagtggacaagtgtttgtgagttggacaagctttcgtaaagtcatgaaaacattgccagacaagatcagctataattaaagatgaattagaaaaaactccaaaa

SEQ ID NO: 32575 - DNA, 484 bp, Homo sapiens
tttttttgtatttttagtagagacggggtttcatcctgttagctaggatggtctcagtctcctgaccttgtgatctgcccacctcggcctcccaaagtgctgggattacaggtgtgagccaccacacccagacactattatatatttttaaaatatgacagattttaaaattgctttaatggacaatttacatatatacatacatagatacagattttggttcaagtggagaaaaatctaatagcaaatgtataaatacatcaattatgttttctcaagttttaagaaaatttgaatacttgttccctccaaaactcatgttgaaatttaaaccccattgtggcagtattgaaaggtggggccttttaagaggtgaatggaccatgagggctctgccctggtgaatgtattaatccattcttggattaatgtattaatggattaatgggttatcatgggagggaactggtgtctttataagaag

SEQ ID NO: 32576 - DNA, 596 bp, Homo sapiens
tacatggctaactggaaaaataaataaaggtaccatagaggaaaaacaaaattgccctgtggggagaacatgtggtgtcatatggtgtgactaaataggatccagtaagataagacaaggtagagcatcttgggagtgattccatgtttcaaggttaaaatgttaactacattaaaggtagtaaaccagtgaaagaatcctcaagatcccagtgcagaatgtttgccaagagataagaagatcaactgttttggtattcatagcagaaagccataggaaaattatctttttgatattcttttttgaagaagataggtcctttatttatttatttatttatttatttatttatttactttattttattttattttttgagatggagtttcgctcttgttccccagctggagtgcagtggtgcaatcttggctcactgcagcctccgcctcccaggttcaagcaattcttctgcctcagctacttgggtggcaattcaaggagaattgcttgaacccccgggaggcagaggttgcagtgagccgagatcgtgcctctgccctccaacctgggtgacagagcaagactccatctcacaa

SEQ ID NO: 32577 - DNA, 795 bp, Homo sapiens
agacaacttagtcatctttaaattatgaagacttaaagctatggcatagtaccttaaattctggtcagtattgatctgcagctaatgatgatgtcacctccacaaatcagacatgggtgctttacagagctacttacaggcaacttctggccctgacttagccttagctctcttgcccaacccccctacacacacatgctttgttgccctaaatttatgaatctacacataggactcctcaactaagtctacatgtggctgatagcagaaggcagcactgttgcacaaacaggaactctgagttcaagcaatactctgcccaagaatttgaaattgttgatgcagaaagagaaaagagcaagcaagaagaaagaaaagaaaagaagaagagtcttcacttgttaatgctccatcttgctttctttgaggtgctcctaatgccttcagaaggcagaagatttatagatctgaagagaaacaacaggatccctgatgccttcaagatattgcatctcggccaggcatggtggctcacatctgtaatcccaggagtttgggaggaccacacagacacgttgcaaggtcaggagatacagaccatcctggccaacattgcgaagccccgtctctactaaaaatataaaaattagctgggtatggtggcatacacctgtagtcccagctacatgggaggctgaggcaggagaatcgcttgaacccgggaggcagaggttgcagtgagccaagatcgcaccactgcattccagcctgtcgacaaagcgagacttgtctcag

SEQ ID NO: 32578 - DNA, 311 bp, Homo sapiens
gtacacatcaacaataccaccctgtttgctgtactgggtatacagaaattattgggcagatgccctcttgaagtccttacatttgatccttatagatggatcacagatgaaagttcaagatgctattttaagagtgaaaatacaagagaatcaaatttgacccacctagacttgaaatgaagatactgatttccacaatgtctgtgtagtttgagacgaagaaacatccagaagagattggaaaaaagagaaagaactgtagagaaatccttctaacctacgaattagggaaggtgggtagttggtgaatt

SEQ ID NO: 32579 - DNA, 423 bp, Homo sapiens
tttgaataagctgattaaaaaaaacccctgctgttataaaaccataaagccctggctcagattttatttcagctctatgtaataataatttctgtttcaactcataatttaatgcaggtgaaaaatctaaatttttatgatgttgttctggattttatattaatggactcctttgaagatttggaaaacccacccacatccatacagaatgtagtaaataatcgatggctaaactcatccttcaaagaaacagtaagtggtggttaacctttctcagccttttaagtttgattaaaaagtgaggctgggcgcagtagctcacgcctgtaatcccagcactttgggaggccaaggcaggcggatcacctgaggtcaggagtttgagaccagcctggccaacatggtgaaaccccatctctacta

SEQ ID NO: 32580 - DNA, 407 bp, Homo sapiens
gctgtactctttccaccatctctcagttgtttttttatattactcactttctttgccttttatttaaaagtgggaaaaatatttagaattttaacattagaatttaatttgttctgtgtactttttctctccttgtaggatattattagtactgaatttatccataaactcgaagctctgctgcaaagagcctatcgtctccaagaggagtttgaagctacccttggggcatctgatcctaattcccttgctgatgatattggtaagatggatatttcatatggcttttatgaaatgtttacttttcttttatatccttggaatcatctgcataagtgtctgtcttatgtaataataggttacttaaaaaaaaataaactagccaagagaaaaaatttttatcatat

SEQ ID NO: 32581 - DNA, 1047 bp, Homo sapiens
gctgtactctttccaccatctctcagttgtttttttatattactcactttctttgccttttatttaaaagtgggaaaaatatttagaattttaacattagaatttaatttgttctgtgtactttttctctccttgtaggatattattagtactgaatttatccataaactcgaagctctgctgcaaagagcctatcgtctccaagaggagtttgaagctacccttggggcatctgatcctaattcccttgctgatgatattgataaagatacagatatcaccatgaagggtaatgtggaagactttggcctgcgagacaccttgagcatcgcatccacggattcctttgcttccgcagcagagcttgcagaacacagagaagtacggcatacctacagcctggagtccctttgtcactgcccattttacgaggaagccatgcatttagttgaagaaggaaaaatttactccagagtactgagaactgaaatgttggagtgcctaggagacagtgattttcttgccaaacttcactgtattcgacaggcttttcaggtaattctttcagaatcagctaacaggatattcctcgctgagagcggaaggaaaattttatcagctttaattgtgaaagcacgaaagaatccaaagaagtttgaagatgtttttgatgaaatgatctattttttagagcagaccgatcactggggtagtactgaaatggaacttgctgctagaggggtgaaaaatctaaatttttatgatgttgttctggattttatattaatggactcctttgaagatttggaaaacccacccacatccatacagaatgtagtaaataatcgatggctaaactcatccttcaaagaaacagtaagtggtggttaacctttctcagccttttaagtttgattaaaaagtgaggctgggcgcagtagctcacgcctgtaatcccagcactttgggaggccaaggcaggcggatcacctgaggtcaggagtttgagaccagcctggccaacatggtgaaaccccatctctacta

SEQ ID NO: 32582 - DNA, 822 bp, Homo sapiens
ggcatcgtctcggtggagacagacctgctgcagtggtgcctggagtcgggcagcatccccatcctgtgccccatcggggagacggccgcgcgccgctccgtgcttctcgactccctggaggtgaccgcgtcgctggccaaggcgctgcggcccaccaaaatcatcttcctcaataacacaggcggcctgcgcgacagcagtcataaggtcctgagtaacgtgaacctgcccgccgacctggacctggtgtgcaacgccgagtgggtgagcacaaaagaacggcagcagatgcggctcatcgtggacgtgctcagccgcctgccccaccactcctcggccgtcatcaccgccgctagcacgctgctcactgagctctttagcaacaagggtgagggcggtgggcgggcgggggactgggtcccgggagtgagtactggccggggctgggtgtctgcggtcaggaggagcggcttctcctcctgtccaggagccgtagggggaggcggggggtgtcacagcaatggctcctgctgctgccgaaacccgggggaggtgagagaggaggagacccagtgtactggaagggaactccgaaggaattaaaggaatgggcgggactaggggggagaaggaggggccccccggtgggcggggccaggggcgggaccataagggaggtgttcgaccaggagagatgggcggggcttaggtgggtgggccgggtcagcggcgggagacagacttcaaggagcgaggcaagactaacggaagtgggtggggctccaggcgacaggaggaacttggggcacaatctctgcctgg

SEQ ID NO: 32583 - DNA, 2233 bp, Homo sapiens
ggcatcgtctcggtggagacagacctgctgcagtggtgcctggagtcgggcagcatccccatcctgtgccccatcggggagacggccgcgcgccgctccgtgcttctcgactccctggaggtgaccgcgtcgctggccaaggcgctgcggcccaccaaaatcatcttcctcaataacacaggcggcctgcgcgacagcagtcataaggtcctgagtaacgtgaacctgcccgccgacctggacctggtgtgcaacgccgagtgggtgagcacaaaagaacggcagcagatgcggctcatcgtggacgtgctcagccgcctgccccaccactcctcggccgtcatcaccgccgctagcacgctgctcactgagctctttagcaacaaggggtccgggaccctgttcaagaacgccgagcgaatgctacgggtgcgcagcctggacaagctggaccagggccgtctagtgtacctggtcaacgccagcttcggcaagaagctcagggacgactacctggcctcgctgcgcccgcggctgcactccatctacgtctccgaggggtacaacgccgccgccattctgaccatggagcccgtcctggggggcaccccgtacctggacaaatttgtggtgagctccagccgccagggccaaggctccggccagatgctgtgggagtgcctgcggcgggaccttcagacacttttctggcgctcccgggtcaccaaccccatcaatccctggtacttcaaacacagtgatggcagcttctccaacaagcagtggatcttcttctggtttggcctggctgatatccgggactcctatgagttggtcaaccacgccaagggactgccagactcctttcacaagccagcttctgaacccaggcagctgaccttcaccatggacactacaggccctggaatggccagggtggaccaaaagccatgccagctgggcatgaccccaggcagccagccacaggctgaagggggcttgttggctgagtgatctgcagaggagaaagcagccccagctctgcccagaggaggcgctgaagtgggacaagcacaggaaagaaggggaccagtctaggaccccaacttgactcactctaaagctacaaccaaatggccttcgattttcaacctggggattaggggaggggagggtgccttccagggctctactcaggactaaccctaagggtgagctagtttctgtgcctctgtgctatgttttgaggctcccttacccaaaataatacccctgcctgcgtgatattctaccattcattttaattcctttgggtcttgcagtttttcaggaggccttgattaaaatgcaaatacttgtctgagagtcagcttacacttgaaagaaaattagaagtgaccccgtgggagcaagatttttttttttttttttaagacaggatcttgctctgttaccaaggctagagtacagtggtgcaatcacagctcactgcagccttgacctcccaggctcaagcaatcctcccatgtcagcctcctaaataagctggtaccacaggcatgcaccgccacacctggatcttttttttttggtagagacgaggtctcactatgttgccaaggctgctctcaaactcctgggctcaagcaatcctccctgcttggcctcccaaaatgctaggattacaggctgggagcaagatcttgagggctggggaatcaggggactcctggagggagtagaagacttctatgatgaatgctgccaccatctccctcccagagattaggaagcatcctcccttccacagaccaggccacagcagccccagctccccttgcctgtgagtgcctccacccacagctccctttctaggctgggctcacagccagacccaggcatcagtggcggaccgtttacctgcaagagcccagagaagttaaaagatggctttggcttaaaagctcaaactttgggaaccgttttttcccccccttaagggcccccttaacctaaggttggggttggttggttcccaggttcttccttaaccaggggaacttccgaatgggggcagaaaaaaatttccaaaatacgccccccccaggcgcgggatctctactaccattttgtgaaacacatattttctctctgtagaaagcctctccccaataacgtgtctacgacaagggacagcccaaataacgcggacgtggcgtgcgtgggggtgacc

SEQ ID NO: 32584 - DNA, 318 bp, Homo sapiens
aaatgagataacacacagcaggaccaagctgggtgcccagcatgcagtaggtcctcaatcaatgttttttaaagacagaaccagtgagtaatgaacactggccttgccctaaaaactgtttcctacatcacctccccacacccaggtacttcaaacacagtgatggcagcttctccaacaagcagtggatcttcttctggtttggcctggctgatatccgggactcctatgagttggtcaaccacgccaagggactgccagactcctttcacaagccagcttctgaacccaggcagctgaccttcaccatggacacta

SEQ ID NO: 32585 - DNA, 421 bp, Homo sapiens
aagccagcttctgaacccaggcagctgaccttcaccatggacactacaggccctggaatggccagggtggaccaaaagccatgccagctgggcatgaccccaggcagccagccacaggctgaagggggcttgttggctgagtgatctgcagaggagaaagcagccccagctctgcccagaggaggcgctgaagtgggacaagcacaggaaagaaggggaccagtctaggaccccaacttgactcactctaaagctacaaccaaatggccttcgattttcaacctggggattaggggaggggagggtgccttccagggctctactcaggactaaccctaagggtgagctagtttctgtgcctctgtgctatgttttgaggctcccttacccaaaataatacccctgcctgcgtgatattcta

SEQ ID NO: 32586 - DNA, 1368 bp, Homo sapiens
cgtagtttcgatgccggaacgtgcaggttgcgaatccccgtaggcgagcgagcggctaggttcgtgatctggagagacgctcagattattaagttcctgcaacttaactgggaactgatcaagatttcaagctaaagatggtggtgatgaacagcctgagggtcattcttcaagcctctccaggcaaattgctgtggagaaagttccagattccgagattcatgccagcgaggccctgcagcctctatacttgtacttacaaaacccggaaccgagccttgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcatgatcaagggaggacccctggaacacaactaccgattgaagcagttccattttcactggggggccatcgatgcctggggttctgagcacaccgtggacagcaaatgcttcccagcagagctgcacttagtgcattggaacgcagtcaaatttgaaaactttgaggatgcagcactggaagaaaatggtttggctgtgataggagtatttttaaagctaggcaaacatcataaggagctacagaaattagtggatactttgccgtcaattaagcataaggacgcccttgtggaatttgggtcatttgacccttcctgcctgatgcctacctgcccagattactggacctactcagggtctctgactaccccacccctctccgagtctgtcacctggatcattaagaagcaaccagtagaggttgatcatgatcagcttgagcaatttcggaccctgcttttcacttccgaaggggagaaagagaaaagaatggtggacaacttccgcccccttcagccactgatgaatcgcactgttcgttcatccttccggcatgattatgtgctgaatgtacaagcaaaacccaagccggccaccagccaagcaaccccctaaaacattcatatctaggcagtattttgcttttgctttaatatatactagcttactataaattgttaactagactattctaagtgcctgcatttgataatatttacagatgtgcatttcttagcatgagagtgcttcatcagtctttgaggaaggctattcggtaccagcaagagacacaagtttctcttacagatacctgttggtaattgtaatgcctttttttttttctttaagagactaggtctagcctgggcaatgagagtgaaactcttatctca

SEQ ID NO: 32587 - DNA, 682 bp, Homo sapiens
gggcttcattctggaaactttgttagggctgcttttcttaagtgcccacatttaacgaaggctggaaatgggtgtattcaaaaccctttaaaatccttaagggagttttgctatagaatctcaggataaagacagactccgacaatattcatccagaaattttcatgtaagtcagttgtttgaaacttgggatttatttttctcttagaaactaagtctaagtggtggttactacatcagcacacaaaatcctgtttaattcataaactaaactgtaataataactgcgtttacttgttcatattgggtttttattgactaaaagcttccagcctctttttcatgcagccaggataacagtgataccaaaacctatcaaagattagaccatcctacccccaaaatataacaataggccaatatctctaaaaaatatgtaacaacagaaaaaaaagctaaataaaatagtagaaatagaatctagcagtgcattagaagaaatatatactttgtccaggtagggtttattccagtaatccacagatggttcagtactaagaatgatatacttacaattaatggatttcatcccatcaacaaatctatatgatcatttccatggatttcctaaaatacgttagacaaaacccaccatccctttaaaaatttttttaataaaaca

SEQ ID NO: 32588 - DNA, 515 bp, Homo sapiens
tcacgtgttaaccctcttttcatggtgtttcagctgcacttagtgcattggaacgcagtcagatttgaaaaccttgaggatgcagcactggaagaaaatggtttggctgtgataggagtatttttaaagctaggcaaacatcataaggagctacagaaattagtggatactttgccgtcaattaagcataaggtactatttgttttccttaattacttgaaatatacttttatgtttcaatctcagagcggagacattaccaaggcactttgaattgggaagtttaattaggtgaactgtattcagccttagaagaaaacttgccatttatgattccaggggacagaagtcatcattctgtgggtaggcagtgagctttctggttttgctgcagtgccgctgaggacttggggactcaggaacatattgctgtcccctcctctgttcctgacaccggctccttctaagtccttgtgaacacacccagagcagccttctgttctgtagctgccatc

SEQ ID NO: 32589 - DNA, 407 bp, Homo sapiens
ggtaaaaaaaaaaaaaaaaaaaaaaaaaaaaaagcattgcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataa

SEQ ID NO: 32590 - DNA, 409 bp, Homo sapiens
gcagcttttctggcaaaccggcttggggccttccagtagaccactggggctgccagaagtttccgtaatctgatttatctgtagaatcttcaaattccacgaggaaagagtacccattattccagacgtggaggcaggtggctgggtcataagagatggtcagtggttttaagccgggatcataaacactgtccctccaccgaatgttgatgggtgactggcgatccgcccccaggaaccaggtccacgctctcccagagtggatgcactgagccagaacctcctcgttcgctcccggtacccgaggatcccgcacgcggccatcttggccacgccccctcacgtttagccacgtcccccttccattctctcggaacaggcaagacccctctggtccgcgtcacttttc

SEQ ID NO: 32591 - DNA, 1316 bp, Homo sapiens
gctaaacgtgagggggcgtggccaagatggcgcgtgcgggatcctcgggtaccgggagcgaacgaggaggttctggctcagtgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagctgcacttagtgcattggaacgcagtcaaatttgaaaactttgaggatgcagcactggaagaaaatggtttggctgtgataggagtatttttaaagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataat

SEQ ID NO: 32592 - DNA, 1570 bp, Homo sapiens
ggacagaaatggcattagtgtttagagaagattatgtatatatggctgtatgaacactgaaaattatgagggtcaacataaaatcagcattacaggtactaaaacataaatcctgatggctttcaccgttttcttaagagcaaaattgcaaaaagtgatattaacagtcatcctagacgaatatgagcaaatgatttgtttttccttaaaagagcctccaagtgtattgtgatcattttcacactgatcaaagagagcacccttctgtcaacaggtatctgcagttttcaggacctggcagaaattcttctatgttctgcctttaaaggtcaggtacaaaagcagagacagctgccaggcccctctgcccagagctaagtgtctgggaccatgagtgggaaggactgaggcttgagcctccttggtcctccagacagcatggggcgctacttgccccttctgcagctgcgcgcggcaaagctgtggcctggccgtggcctcctgccccatgcaacagttggtggacagaccgtacctggcacacggcgccttgtgcactttccaacattttgatgctaaccgtcgctagtcactgagccctgacatttgatctctggccttgaccgcagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataat

SEQ ID NO: 32593 - DNA, 1713 bp, Homo sapiens
taggtggcagcgacttggagtcagaatcccactgggaatcctttaactgggagcagtatttcgtttagctcagtttcataatggagaacagctgttcgcagatgtaggtgctcccgaacatggaaagaatctttgcgcaatggtgcttgtatttcgggtagctaccccagaggtacttgtagaattctggtattcccaccttgtcgtatttcgtcttcaggaccgtgttgcattacaggtactaaaacataaatcctgatggctttcaccgttttcttaagagcaaaattgcaaaaagtgatattaacagtcatcctagacgaatatgagcaaatgatttgtttttccttaaaagagcctccaagtgtattgtgatcattttcacactgatcaaagagagcacccttctgtcaacaggtatctgcagttttcaggacctggcagaaattcttctatgttctgcctttaaaggtcaggtacaaaagcagagacagctgccaggcccctctgcccagagctaagtgtctgggaccatgagtgggaaggactgaggcttgagcctccttggtcctccagacagcatggggcgctacttgccccttctgcagctgcgcgcggcaaagctgtggcctggccgtggcctcctgccccatgcaacagttggtggacagaccgtacctggcacacggcgccttgtgcactttccaacattttgatgctaaccgtcgctagtcactgagccctgacatttgatctctggccttgaccgcagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataat

SEQ ID NO: 32594 - DNA, 1299 bp, Homo sapiens
gctaaacgtgagggggcgtggccaagatggcgcgtgcgggatcctcgggtaccgggagcgaacgaggaggttctggctcagtgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagctgcacttagtgcattggaacgcagtcaaatttgaaaactttgaggatgcagcactggaagaaaatggtttggctgtgataggagtatttttaaagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgcctgtctcactgggacaggagacatgcttctccccagttctctctcactga

SEQ ID NO: 32595 - DNA, 1280 bp, Homo sapiens
gctaaacgtgagggggcgtggccaagatggcgcgtgcgggatcctcgggtaccgggagcgaacgaggaggttctggctcagtgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagctgcacttagtgcattggaacgcagtcaaatttgaaaactttgaggatgcagcactggaagaaaatggtttggctgtgataggagtatttttaaagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccacctctcctctcccttaaagcccttcccttgcccttgcccattcgctcctgccttctccctggggacaggaggcatgcttctccccagtttccgcaataaaatatttgttgttaataat

SEQ ID NO: 32596 - DNA, 1262 bp, Homo sapiens
gagatgtgtagccagagcgcagagcagtgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagctgcacttagtgcattggaacgcagtcaaatttgaaaactttgaggatgcagcactggaagaaaatggtttggctgtgataggagtatttttaaagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataat

SEQ ID NO: 32597 - DNA, 1276 bp, Homo sapiens
cggaccagaggggtcttgcctgttccgagagaatggaagggtgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagctgcacttagtgcattggaacgcagtcaaatttgaaaactttgaggatgcagcactggaagaaaatggtttggctgtgataggagtatttttaaagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataat

SEQ ID NO: 32598 - DNA, 1487 bp, Homo sapiens
ggagcacatgttctcaggtcctcctgtgggctgtgtcacaggccatagtcacccatattggctcagaataaatctcttcaaatattttacagagttcgactcttttcgacaacacttggtttggcctagaaagtgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagtgatcaagggaggacccctggaacacaactaccgattgaagcagttccattttcactggggggccatcgatgcctggggttctgagcacaccgtggacagcaaatgcttcccagcagagctgcacttagtgcattggaacgcagtcaaatttgaaaactttgaggatgcagcactggaagaaaatggtttggctgtgataggagtatttttaaagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataat

SEQ ID NO: 32599 - DNA, 1265 bp, Homo sapiens
  misc_feature (15)..(15): n is a, c, g, or t
  misc_feature (21)..(21): n is a, c, g, or t
ggacggccaggactncagganaaagagagtgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcaggctgcacttagtgcattggaacgcagtcaaatttgaaaactttgaggatgcagcactggaagaaaatggtttggctgtgataggagtatttttaaagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataat

SEQ ID NO: 32600 - DNA, 1378 bp, Homo sapiens
ggtaaaaaaaaaaaaaaaaaaaaaaaaaaaaaagcattgcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccccatcaacattcggtggagggacagtgtttatgatcccggcttaaaaccactgaccatctcttatgacccagccacctgcctccacgtctggaataatgggtactctttcctcgtggaatttgaagattctacagataaatcagctgcacttagtgcattggaacgcagtcaaatttgaaaactttgaggatgcagcactggaagaaaatggtttggctgtgataggagtatttttaaagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataat

SEQ ID NO: 32601 - DNA, 1457 bp, Homo sapiens
gggactatttctactccacataatctgattattaagttcctgcaacttaactgggaactgatcaagatttcaagctaaagatggtggtgatgaacagcctgagggtcattcttcaagcctctccaggcaaattgctgtggagaaagttccagattccgagattcatgccagcgaggccctgcagcctctatacttgtacttacaaaacccggaaccgagccttgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagctgcacttagtgcattggaacgcagtcaaatttgaaaactttgaggatgcagcactggaagaaaatggtttggctgtgataggagtatttttaaagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataat

SEQ ID NO: 32602 - DNA, 1445 bp, Homo sapiens
gcagcttttctggcaaaccggcttggggccttccagtagaccactggggctgccagaagtttccgtaatctgatttatctgtagaatcttcaaattccacgaggaaagagtacccattattccagacgtggaggcaggtggctgggtcataagagatggtcagtggttttaagccgggatcataaacactgtccctccaccgaatgttgatgggtgactggcgatccgcccccaggaaccaggtccacgctctcccagagtggatgcactgagccagaacctcctcgttcgctcccggtacccgaggatcccgcacgcggccatcttggccacgccccctcacgtttagccacgtccctacgcagcaaacgtcatttcgtcattccaggttacgcccctatcagtccccattctgtccccgacccaggctgaaatctcgccactggccacgcttccccagcgcacggagtccacacctgctctgcgctctggctacacatctcctgtcgctgccacgcgcctgcacgctaacttgccgacgcctctgccctccgcctgctccaccatctttgttacgcccctcagagcaacaaggcacgcccacacgtaaggaccgcgccccccacgttcgaggcacgtctctgcgttccaactacgtcatgtccctacttcccttttcgcgccacctcccttgccggtcactactccgcagcccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataat

SEQ ID NO: 32603 - DNA, 1237 bp, Homo sapiens
gcagcttttctggcaaaccggcttggggccttccagtagaccactggggctgccagaagtttccgtaatctgatttatctgtagaatcttcaaattccacgaggaaagagtacccattattccagacgtggaggcaggtggctgggtcataagagatggtcagtggttttaagccgggatcataaacactgtccctccaccgaatgttgatgggtgactggcgatccgcccccaggaaccaggtccacgctctcccagagtggatgcactgctctgcgctctggctacacatctcctgtcgctgccacgcgcctgcacgctaacttgccgacgcctctgccctccgcctgctccaccatctttgttacgcccctcagagcaacaaggcacgcccacacgtaaggaccgcgccccccacgttcgaggcacgtctctgcgttccaactacgtcatgtccctacttcccttttcgcgccacctcccttgccggtcactactccgcagcccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataat

SEQ ID NO: 32604 - DNA, 1788 bp, Homo sapiens
ggccaggactggccagaaaagagaggtgtggaatgcatgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagctgcacttagtgcattggaacgcagtcaaatttgaaaactttgaggatgcagcactggaagaaaatggtttggctgtgataggagtatttttaaaggaaaattctcagtctcccttgaagaagtgaagcctccttctttatgcactggccactgtctaatacctcccagcaatactcagaggagactacctgctggaacctcactagaattgagagatcaaatggttttggctgttttcccactggagaatataaaaaatacacagttaattttagaaacaaaggctgggcatgattccatcctaagcagcaattcttcaggtagctgcccagaagggcctggagctcctctggaccactgctgatctccagatactccctgagaaccgtcacctcggcgtccaattcctgagtggttttcactactaaataatgactcagtgacccagtctcttggccaggacgctgttatggaatttgggtcgtttggcacttcctgcctggtgcccacctgtctagattactggacccaagtaggtccagtatctccctggtccagccctgtcttgagtccatcacctttatcattaagaagcagccagtagaggttgatgatgatcaggtacgttctctccacaattttcatctaaggaaatcctcgtctccccttttaaaacaaggctgggctcagactgtggcatcagttttaacatcttgtaatgcttatacatttttattgaagtgtaccaacgtcttatctcagtttggacatgaatttagagatatttcaaattagctagagagaagagttaaaacatagaagaacataagctttttacatctatatttgacagtgacatatgtttttattatacatgcattgtgtagattctctatgaaaattaagacccttttaaataaaaaaacgaaggctggaaatgggtgtattcaaaaccctttaaaatccttaagggagttttgctatagaatctcaggataaagacagactccgacaatattcatccagaaattttcatgtaagtcagttgtttgaaacttgggatttatttttctcttagaaactaagtctaagtggtggttactacatcagcacacaaaatcctgtttaattcataaactaaactgtaataataactgcgtttacttgttcatattgggtttttattgactaaaagcttccagcctctttttcatgcagccaggataacagtgataccaaaacctatcaaagattagaccatcctacccccaaaatataacaataggccaatatctctaaaaaatatgtaacaacagaaaaaaaagctaaataaaatagtagaaatagaatctagcagtgcattagaagaaatatatactttgtccaggtagggtttattccagtaatccacagatggttcagtactaagaatgatatacttacaattaatggatttcatcccatcaacaaatctatatgatcatttccatggatttcctaaaatacgttagacaaaacccaccatccctttaaaaatttttttaataaaaca

SEQ ID NO: 32605 - DNA, 1773 bp, Homo sapiens
ggctgacgagctttctcctagtgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcaggctgcacttagtgcattggaacgcagtcaaatttgaaaactttgaggatgcagcactggaagaaaatggtttggctgtgataggagtatttttaaaggaaaattctcagtctcccttgaagaagtgaagcctccttctttatgcactggccactgtctaatacctcccagcaatactcagaggagactacctgctggaacctcactagaattgagagatcaaatggttttggctgttttcccactggagaatataaaaaatacacagttaattttagaaacaaaggctgggcatgattccatcctaagcagcaattcttcaggtagctgcccagaagggcctggagctcctctggaccactgctgatctccagatactccctgagaaccgtcacctcggcgtccaattcctgagtggttttcactactaaataatgactcagtgacccagtctcttggccaggacgctgttatggaatttgggtcgtttggcacttcctgcctggtgcccacctgtctagattactggacccaagtaggtccagtatctccctggtccagccctgtcttgagtccatcacctttatcattaagaagcagccagtagaggttgatgatgatcaggtacgttctctccacaattttcatctaaggaaatcctcgtctccccttttaaaacaaggctgggctcagactgtggcatcagttttaacatcttgtaatgcttatacatttttattgaagtgtaccaacgtcttatctcagtttggacatgaatttagagatatttcaaattagctagagagaagagttaaaacatagaagaacataagctttttacatctatatttgacagtgacatatgtttttattatacatgcattgtgtagattctctatgaaaattaagacccttttaaataaaaaaacgaaggctggaaatgggtgtattcaaaaccctttaaaatccttaagggagttttgctatagaatctcaggataaagacagactccgacaatattcatccagaaattttcatgtaagtcagttgtttgaaacttgggatttatttttctcttagaaactaagtctaagtggtggttactacatcagcacacaaaatcctgtttaattcataaactaaactgtaataataactgcgtttacttgttcatattgggtttttattgactaaaagcttccagcctctttttcatgcagccaggataacagtgataccaaaacctatcaaagattagaccatcctacccccaaaatataacaataggccaatatctctaaaaaatatgtaacaacagaaaaaaaagctaaataaaatagtagaaatagaatctagcagtgcattagaagaaatatatactttgtccaggtagggtttattccagtaatccacagatggttcagtactaagaatgatatacttacaattaatggatttcatcccatcaacaaatctatatgatcatttccatggatttcctaaaatacgttagacaaaacccaccatccctttaaaaatttttttaataaaaca

SEQ ID NO: 32606 - DNA, 679 bp, Homo sapiens
aagggtgtaaaaaagaaattcgaattcgcgggacggtcggcctcaggcggagtagggacgtgagcccaagggagggaggtggggtaggcagactagttgtgactggatgatcactgggcgaagggtggaaaagtggccacagatggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataat

SEQ ID NO: 32607 - DNA, 1389 bp, Homo sapiens
ggccaggactggccagaaaagagaggtgtggaatgcatgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagctgcacttagtgcattggaacgcagtcaaatttgaaaactttgaggatgcagcactggaagaaaatggtttggctgtgataggagtatttttaaaggaaaattctcagtctcccttgaagaagtgaagcctccttctttatgcactggccactgtctaatacctcccagcaatactcagaggagactacctgctggaacctcactagaattgagagatcaaatggttttggctgttttcccactggagaatataaaaaatacacagttaattttagaaacaaaggctgggcatgattccatcctaagcagcaattcttcaggtagctgcccagaagggcctggagctcctctggaccactgctgatctccagatactccctgagaaccgtcacctcggcgtccaattcctgagtggttttcactactaaataatgactcagtgacccagtctcttggccaggacgctgttatggaatttgggtcgtttggcacttcctgcctggtgcccacctgtctagattactggacccaagtaggtccagtatctccctggtccagccctgtcttgagtccatcacctttatcattaagaagcagccagtagaggttgatgatgatcaggtacgttctctccacaattttcatctaaggaaatcctcgtctccccttttaaaacaaggctgggctcagactgtggcatcagttttaacatcttgtaatgcttatacatttttattgaagtgtaccaacgtcttatctcagtttggacatgaatttagagatatttcaaattagctagagagaagagttaaaacatagaagaacataagctttttacatctatatttgacagtgacatatgtttttattatacatgcattgtgtagattctctatgaaaattaagacccttttaaataaaaaaacgaaggctggaaatgggtgtattcaaaaccctttaaaatccttaagggagttttgctatagaatctcaggataaagacagactccgacaatattcatccagaaattttcatgtaagtcagttgtttgaaacttgggatttatttttctcttagaaactaagtctaagtggtggttactacatcagcacacaaaatcctgtttaattcataaactaaactgtaataata

SEQ ID NO: 32608 - DNA, 982 bp, Homo sapiens
ggacagaaatggcattagtgtttagagaagattatgtatatatggctgtatgaacactgaaaattatgagggtcaacataaaatcagcattacaggtactaaaacataaatcctgatggctttcaccgttttcttaagagcaaaattgcaaaaagtgatattaacagtcatcctagacgaatatgagcaaatgatttgtttttccttaaaagagcctccaagtgtattgtgatcattttcacactgatcaaagagagcacccttctgtcaacaggtatctgcagttttcaggacctggcagaaattcttctatgttctgcctttaaaggtcaggtacaaaagcagagacagctgccaggcccctctgcccagagctaagtgtctgggaccatgagtgggaaggactgaggcttgagcctccttggtcctccagacagcatggggcgctacttgccccttctgcagctgcgcgcggcaaagctgtggcctggccgtggcctcctgccccatgcaacagttggtggacagaccgtacctggcacacggcgccttgtgcactttccaacattttgatgctaaccgtcgctagtcactgagccctgacatttgatctctggccttgaccgcagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgccctctcctctcccttaaagcccttcccttgcccttgcccattcgctcctgcctgtctcactgggacaggagacatgcttctccccagttctctctcactga

SEQ ID NO: 32609 - DNA, 604 bp, Homo sapiens
atatatcatcccccccaccaccaaaaaaatatatatattttaaatgatataaaaatgcacagcccaatagagtggtcacaagccacatgtggcaattgagcacttgaaatgtgtctactgcagttctggaaccatttttcattttatttaattttaatttcaatttaagaacttaaatgaagcagggggcacctttcactgcaggcatgctgaccttgtcagcaaacagcctgctgatttgttctctaatttaattcagtaatgtttataaaattataaattacaagtttaagtgtaatttcagtcatgcagtttgtttttatgtaatcaccaggtagttaattttaattcacattctgttacagttgctacagtgagatgtccattgtttgtaatattttcttacttgtggttctttagctaggcaaacatcataaggagctacagaaattagtggatactttgccgtcaattaagcataaggtactatttgttttccttaattacttgaaatatacttttatgtttcaatctcagagcggagacattaccaaggcactttgaattgggaagtttaattaggtgaactgtattcagccttaga

SEQ ID NO: 32610 - DNA, 422 bp, Homo sapiens
cagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagtgagggcaagatctggtggtcttgtaaggagttaaagaaacagtgtcatgttaacagaggacacatcaaactctctccatgatagtattgacctctttgtgagcaatggcatggaactcattggaatttaaaaaaaaattgtggtgaaatacacataatatgaaatttatcatcttaaccatttttaagaatacagtcaagtagtattatattaagtacatttccattagtgtacaatcatcaccaccatctatctccagaaatcctttca

SEQ ID NO: 32611 - DNA, 417 bp, Homo sapiens
tgagccactgcactcggtccaacagtcttgataataggctgacgagctttctcctagtgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcaggtgagggcaagatctggtggtcttgtaaggagttaaagaaacagtgtcatgttaacagaggacacatcaaactctctccatgatagtattgacctctttgtgagcaatggcatggaactcattgatcttaactttttgaatgtgtgaaaaaaaattccttct

SEQ ID NO: 32612 - DNA, 385 bp, Homo sapiens
acaaaatcttagaataaccaattttaatgagaaattatagcaatttgcacaatataagattaatatacaaatgtcaattactgtcctatatatcagtaatgtagttagaatttgaaatttaaaaattcagtgacatttaggctagcaccaataacaatgaaattcttaggtacaaatataacaaaataaatataaatatagaatctatatgaagaaaccggcaaaactgtaaaaacatcaaagaagatctaaataaatggagagataatccacattcaagtaaagaaggcttcaacattgttaaaatgtcagtacttcccaactacatttacatattcaatgcaatcccaatcaaaattccacaaagttagtttgtggatattga

SEQ ID NO: 32613 - DNA, 807 bp, Homo sapiens
tgggggtcaagtgggcctccagacaccctgagctgcatggagaacagcaagggccttttgctcatctgcagtgtacagcactgcctctacttcatcttgatgctgctcctggtcagtcttctcggcacgctggggacctccttactcacagacccaattcctgttaaacaagttaagtgctgccaggtagggtgctctggggtggaccctgcagttctagggagtcactgaagaatagggaaattcctgcattgtctttggaaaggggagggtttgggggagcattggggtgggcagaaacaggcaggtacattttaaagggctcagcagagtgaaacaaagctgaactcaaccagatgtcctgcagcgatctgccaggtattcctttagatcgagaagtttggcttttaaaatgcaaattttccttggaagttttaaatccaccaaccttagtatgaattaatacaatcagggcactcccagctgttacccacccagggggaatgaagccaatggacattcagcccccactgtagtgcagtaggtgagagcatggcaggctctggagcagactgccaggatgccgatcctagccttgcccttactagtgtgtgtgatcccggatgaatatttaacttttctgtggctcagttaaatggatgtaataatatctacctcaaagatcagttatgaggattaaatgagttaatcaatgtaaagcacttagaacagtgtttcgcatatgtacgcctcatcttagtattagctgctgttattgttactattaataaacaatccttgaagagc

SEQ ID NO: 32614 - DNA, 375 bp, Homo sapiens
ggttgaaaaactacctattgggtactatgcttactaccaggacaagatcaactgtactccaaagctcagcatcacaccatatacctttgtaacaaatctgcacgtatatttcctgaatctaaaataaaagttaaaagaaaaagacattctttaacatttgccataattaggactattagcaacaaattttctcagcttttgagaaaatctttatttcactttcatttttcaaagatatttttcactacgtacagaattctacatctgtaagtccttttagtattttaaaggtgccccactgtaagtcttatttttactcttctgtgtataatgtttccatcttccctttgatttgccttcaaagtgttcttaata

SEQ ID NO: 32615 - DNA, 489 bp, Homo sapiens
agtattcggcatgaggtttttagacatcaatgaaaaagtttatgctgtaaccacacccaatttctatagtctcttttgtgaaaatatatttgcttcatcctgaaactaagaaattgctatctatctataacacatagccaaataaatgtgcattttataacttctctccagaagtactatttaatgtatcttaaaaatcaactcttgtactgaatatattaaggctgtttctggatgggagccagcgaatgctttgccaaaagacatctgcacacaagatgtccagcctgtgagtcaattctcctgattatcattcaggaatttgtctctctgagctggcataactatgtttgcctgcttggttcaatattgctggcattcttaacagaaggaatatggattgttttagaaaggtctctatatgttcagatagagcctttacctgaggtcccagctgactctatttaatacagaatggcacatagtctc

SEQ ID NO: 32616 - DNA, 410 bp, Homo sapiens
ctatgtttctagtgtagaatctggcacagaaaccacccatagcaggtgcgccacggacctgctttagctggaaggatcctttctacattccttccaccacctagtgagtggccacgttgatgatgagacctgggcctttaaaaatcctctttcaggtctccagccaaccctctccattcaactcagtttcacaaaccttttcttagcagccacccattcccaaggactgtagtgggtgccgcaggggagacagaggtgaaggagacacagtcctttctgctgattctgcggctgagtcagctgatagcctacgtctatttgccaagaatatgatcaactgagtgaaaacaacaaaataaaaaacgctgagttggggagatgactcgactcgggaggataatgagaatgtc

SEQ ID NO: 32617 - DNA, 562 bp, Homo sapiens
ttttttttctttagagggagtctggctctgtcacccaggctggagtgcagtggcgagatctcggctcactgcaaactctgcctcccgagttcaagcaattctcctgcctcagcctcctgagtagctgggattacaggcagacgccaccatgcccagctaatttttgtatttttagtagagacagggtttcaccattttttggtcaggctagtctcaaactcctgacctcatgatcctcccaccttggcctcccaaagtgctggtattacaggcatgagacaccgcgcctggcctgaatagaatctctttttaccccgagatcttctcaaaattttctgtccacctgcatgaacctggacctggtattttctaaccctgagacatagctgaggcctgagatttccctccatcactctcctgggttagattagttatttcctggattctgtgccttctctgttctcagaaccctcattttattggtgtatctgctcaagtaaactctccagggggagtgccttggacatgaacaccatttctctgcatcactgaagaaatcttt

SEQ ID NO: 32618 - DNA, 544 bp, Homo sapiens
gtgggaaatgggagagaataagggaagaaattcagtcctggagaagctttcagtagtctcataggaaacatctgtaggtctaaaggggaaaaccagtgtctgcaattgactagaatgcactgctagggcagggactgctggggcagggaaactactggggaaggggctgctaggtgctattgttattgataataataaatggcatttaccaaaacaaaaactaatatgttcctgaatctgcgctaagtgcctttatttatgtgaccttatataattcccacaagaactccatgtagttcttgaagttcatgactaataatgaactatgactgtgccctttatatagattggaaaattgaagctggaaagtgaaggagcctttgaagagcagaagcagaaggcttccagttcagatctgtctctctgcagagctctcctttgttctagccagtttccatcttcttggtgttgctaagacaagctgttactaagaggaggctatcctgactgacggctcatgctggtttgagggtccttctcttat

SEQ ID NO: 32619 - DNA, 377 bp, Homo sapiens
ggcctcgacagtgctgggactacaagtgtaagccaccgcgccccagccaagatatttgattttaaggaaaaataggaaaaatcaatttcaaagaaaatgtttaaagccatgccaactaagtatctccaagccaaagttgactatcttcaagccaaagttgacagacaggccaatgtactattttatttccttgactcctaaggcaatgtagggtggtaaaaagggcatggcctccgaaatctgagagacctcaatctggatcctctactggagagcttatgtaattaacccatgagcttcaatttcctcctctctcaaatgaagatagtaatatccaactctagaaggtttcatgattgttaaatgagaggtcgacg

SEQ ID NO: 32620 - DNA, 1525 bp, Homo sapiens
actctgaaaggatcctgaccaaaacgttcctggtagctgtctcaggataatggaatttgagattattctactttaattctttcatatagccttctaatttgctataataagcatggatgatttttattttggggagaaaaaagcaattgagattatatactgtcacttcccagtctttttttaaaagtcagcttccattctaaagatatgtttgcgttgaaacgattgttctctacctttctacatttaaaaaatatataatataatatactctgagtttcaccttcctaaaatactttagaaccataaagggaagcttgttttatcttcaaatagtttttgtggtctgtattttactggatattactatatggctcactagggtgtgcccatccaaaaagtcagctcaatgtcttggaaagataaagggttctagagtcaaacagcatggtttaaatcttgttttataattgttacatctctgacattgagcagatgactgaactacattgaatcgcaactaaaaaattcaaataatttctgcctttcaggtttatattagaaatagtatggaaaatttggtaaagtaactaaactaaaaacttttccaatatgagcatccattggatattctagataaaatattacagatataactagcatcctttaaaatgcatgattgagattagaaaaacagaaaaggatatttccaggggcaagacatgcaagaaataaaatagaactgggaactaaacaggtaaaccctgggatctaaatttgtggttggtatagtttggataagggagagccatcagttttggcaattgagtggcttgaatattcttgttcaccccaggagagatgtggctttgcaactctgcaaggtagtgtattgggactaacacttttaaaataaggattttaaatgagattttcaggacccctgaaacgacccctgaaaatctacatgtttggtgaaagggtgtactagggaaaaaatatgtatatgcatatgtctagctacctaccttaataccatgataattaacatgatttgatttaactgtcatcttactatctttgcctaggatctaagtggaaatttataaccattgtcttatacctcaaaagacttgatgtttgaatttatactgctcagtatggtgtgaaaatgcctgagctgaaaaattaagtgaaaaaaaaaaaaagattccaggttagtgatgttgcagggatacctagaaattaacgtaaaatcgctctgagggaggacatggacttgacccagggagcacatgattcccacagattaaaacccactgaatctgaaaattaaaaacatgaaaaaagtaaacaaggcatcaaaataagggtcagtaaacaacctaagggctttttactaaattttgactttggtgagaagtatacaaattagtattttagaataaacagaatgcaataacaacaaaaaataaataaaactagaaagtacaattttcacagttaagatgaacaaagaagagac

SEQ ID NO: 32621 - DNA, 508 bp, Homo sapiens
gcagtcatcctggcgggacatgcagaggggctgtcctctaaatggaacgttccagagactggcaaagggaaggctctagagctcctctgcagagtctccacgggctcccacaagcccaagagttgggggcagtagcatgccagatccagcgcatactggcttttgagagctgatggctaacttttcagtaatttttttgcaagccagctttaaaaaagttaacttatgaggccgggtgcagtggtgcctcacacctataatcccagtactttgggaggctgaggcgggtgatcacttgatgtcaggagttcgagaccagcctggccaacatggtgaaaccccatctctactaataatgcaaaaattagttgggcgtggtggcacgcgcatgtaatcccagctacctgggaggctgaggcaggagaatcacttgaacccaggaggcggaggttgtgccactgtactccaacctgggcaacagaatgaaactgtgtctcaaaaataaata

SEQ ID NO: 32622 - DNA, 394 bp, Homo sapiens
gtcggtgatggggaccgagtggactctctgggtcttcccccctctgaaaaggctcttcctggaaaagaagttggacacagttggggttttccttgactgcgaacacgggcagatatcattctacaatgtgaccgagatgtccctcatttacaatttctcccattgcgccttccaaggagctctcaggcctgtgttttccctctgtatcccaaatggagacacaagtccagactccctcaccatcttacaacatggtccttcttgtgatgctactgttagcccttaatcttctgtgtgtaaaatccaagaccacgagacaccagaaagttggagaacaagactttgaaagaatttgtgtaaactaacccaataaaaagcgttccaggaaaaaaag

SEQ ID NO: 32623 - DNA, 424 bp, Homo sapiens
caaaaaaaaaacaaaacaaaaaacagtaagtaaatctttactcttggacccacctgtattgtatcaaaagtgtgcctgtgtttctgtatagtcaggggttgaactggatttttagttaggtgggtacacatttgtgcagggaggattctccaaggtcatttgtttcacaggcttgttctgagggctgaatgtggagtgcgtatcctgctgtcagttgctcagtagatgggctctgcaattatacactgagtccctttccctgtcttggcattagaactgtgcttcagtactgccgatagtctgccctgcttgttaatgtattcagaggaggatttgagtcacttatcgatatggacaggtctccactaagccaaaccccaacgcagccaaggctgcgagacagctccctcagatagcggccgcc

SEQ ID NO: 32624 - DNA, 787 bp, Homo sapiens
gggaggccatgcatgggttggattggggagctcacaggagagaacctgctggctgggccaggcctgtgtggggcagggccggaggcaggcagcatgcgggaggcctggctagatctgcatggagcagatccatccaggtggtggctgtgagccaggagggagggactgaggcttctctggggcagggggtatggatttgcggctggatagcaggcacacttgactcccactcccaggaaaatgatattgtaggacagtcaggacacctggctcctggtcctgttgctgcctcgggacttgatatgtgactagccaagccggacccttccagtgtcattgtcttgctgatgcttggacatttgccttggagttgacccacctagggaccctctgaggacatttgtggacaatcctggagagtatgcctagggcccaggtgggcgggctctgcctatgaagcgaggggattccccagctccctgtcatctggcttttctcccagcggccagttcagtttctggctgtgccccccagggggcaccatctcacaccgcaatctgggccgctgctgggccaaggaatacttaatgttaagccttctttctcctggcccgccctgctggctcctgacttcctgcctaaaggcaaacaaggagtccaaagcccggatcctcctcccgggccttcttcctggtgaagagcgcattcccacccagcagggaacagaaaaaccagttccccgggtttccctccctgcctgggaatagcgaagtctggaaagttggca

SEQ ID NO: 32625 - DNA, 786 bp, Homo sapiens
tcatgcctgtcatcccagcactttgtgaggccgattctcctctatccaggagacgggtttcaccattttgccaggtttgtctcaaactcctcggcttaactgatccgcttgctttggccttccaaagtgctgggattacaggagtgagccaccacacgtagccagtcctggcattttgtagaaggatggccaacgcagcctgttgacccttcctggccatcacatgaaaatcagcgactcttccttcttacaaaactcggagcttctcaggataacttggtgaaacgtcccccgctgtgaacctcagtgagcccacctgtaatatacaggtgagggagaagaccagaaaagctcagtcagagtgacactgacccctgaaatgatgggcacaatggagtgtgtggcttttcctgtaggacagggaggtgcttagctgtaatttgaactttaaaggattccagtcctccgaaaaacaggattagactcaaatcaccttgaaccttatcatctcacggctttgacccacctacatggctccgtgtcccctgcaggcctcgccccggagctctacaatcctgtgtgcagttgtctccgcagctctctgctgggacatcaaacaggcatctccaccttcatgtgtctataagtgacttcctaaacccccaaacacattcccttacagtcctacacatctcagatgagggcgacagtgtacttctgggtgcttagctgaggttgacaccatgtattttaaatatggaaaataaattacattatttgtaaatg

SEQ ID NO: 32626 - DNA, 426 bp, Homo sapiens
tcggcctctgagcccactcttactgttggacatgtgatgtcgcaggctcgtcccatgctctccctgccccagccctcagatgctccatttcttggaggagacctggcgcctttgagtggagggtgacttaggcaccggatgtgttcaccactgccagggagcagcattcctgggcactgttaacagttaggaagcagacacgcatctctgcaccacacatggacacacacactcttctattctgtgtctgtatatcaaatccacaagtgcagcggggcatgccggcacacacctgaggtcccagccactcgggaggctgaggcagggggattgcttgagtctgggagttcagggccacagtgaacgtgaactatgcattcgtgaactatccattgcagcctgggcaacagagcaagaccctttttc

SEQ ID NO: 32627 - DNA, 383 bp, Homo sapiens
ccagcctgggagatccctgctctataaaaatgaaaaaattagccaggtggggtggcacatgcctgtggtaccagctacttaggaggctgaggtgggaggattgcttgagcccaggaggtcaaggctgcactgagctgtgatcctaccactgtgcgctccagcctgggcaacagaacaagaccctatctcaagaaataaaacagactatttccaaaggcgtgggctgggcttaagaaactaacaaggggctgggtttggtggctcacatttgtaatcccagtactttgggaggccgaggcaggcagatcacctgaggtcaggagtttgagaccagtgtggccaacatggcgaaaccccatcctattaaaaatacaaaaattagc

SEQ ID NO: 32628 - DNA, 371 bp, Homo sapiens
ttcactgctactcattttagatggccattttggtttcattaattgtttttgacctttcttccccttctcagttcccatccagaagaactttactaaaaagaaatattctgtatacagttcaatttattgagtaaagatattcagtagctttgtttttaagattcagaactggccgggcatggtggctcatgcctgtaatcccagcactttgggaggccaatgcaggtggatcacttgaggtcaggagttcgagaccccccctggccaacatgacgaaaccccatctctactaaaagtacaaaaatgagctgggcatagtggcaggtgccttgtaatcccagctatttgggaggctgaggcacgagaattgc

SEQ ID NO: 32629 - DNA, 572 bp, Homo sapiens
atgacaggcagtgcaggcagacatcattctgttcggctgaagttcaatgaatggcattgctgctctcaacctcttttgggtactatcccgcctaagaaaagcggggtgggagaatggaaatatatttgcattttcatgcatattaagtctcccacaaagatggctctttgttttcttacggtttgcaagctcctgaggactagaaatcggtgaagggggaggggagagcgagtgttctgagattgttcctcccatcccctcccaaagctaatctcgttctagcactgcactgcttttccaaactagctgttgtatgcagtcccattcatcccttctctccagaacttgacacctgtggctcctgcaagtggaaggcccgggaatgggaatgaagcggggtggtgggcagggaagcgttatgctcggagagcccttaaaattctcctggaggtcggcagcggcgcccgcctgtagcctccggcctagaggcttcgccgcccctcggactagaacacagcccggccgttgtgcttgcctccccttcccaggctgtgagacggcggccgcaccac

SEQ ID NO: 32630 - DNA, 527 bp, Homo sapiens
tgttactatcaaaaagtgggaaaatgatgaaataacaaaatgagataaaacaaagttttacaggaaaggaaataaaatcattgaacactacatggctcagatgtgaataataccgtagttaagcagtcataataatgtcaacattgaaaatgaatctcacagaactgataaaactaaattaggaggaatatttctaaactcattttacaagaccagcattaccctgataccaaagccagacaaggacactacaaaaatagaaatttacagaccaatatccctgatgaacataaatgcaagtcgtcaacaaaaccctagcaagctatattccacaacacattacaagactcattccccatgctcaagtgggatttatcctggggctgcaaggaaggttcaatatacacaaatcaacaaatgtgatacaccacattaacagaatgaataaaaatcatgatcatttaaatagatgcagagaaagcatctgacaagattcaacaccccttcataatgaaaaaacaaacaaa

SEQ ID NO: 32631 - DNA, 1767 bp, Homo sapiens
tgcagctggagcgcgggccgccgcggcgacatcttgctcaggaggaaagcgcgcgggagagcgagctgcgctttagctgctgcgccacgcgcgcctcgggcctgggcgcagaggatcggccgggcgcggcgggaaggaggctgcgggcagcgaggagcggctggcgctcgaggcggcggacggcaccatgtccccggggagcggggtgaagagcgagtacatgaagcgctaccaggagccgcgctgggaggagtacgggccgtgctaccgcgagctgctgcactaccgcctaggccgccggctgctggagcaggcgcacgcgccctggctctgggacgactggggcccggccggctcctcggaggactcggcgtcgtcagagtcgtcgggcgccgggggccccgcaccccggtgcgccccgccctcgcccccgccgcccgtagagccggcgacccaggaggaggcggaacggcgggcgcgcggggccccggaggagcaggacgcggaggccggggacgcggaggccgaggacgcggaggacgcggctctgccagcactgccagtgaaagatgtagaagataaacctgaacaacaaaccagaacaagagagactgacaaatcacccaccagtactgagcctcgacagcaaccaagtgccttatttgctagaggaaacaggaaagcggtcaaaagtccccaaagatcatcgagtaaaataaaagaaaacaagcatccatttgctctttatggctggggagaaaaacagaccgatacaggaagccagaagactcacaacgtctgtgcgtccgctcctgtgcacgagattcatgaatcagcattacgagccaagaacagaagacaggtggaaaaaaggaaactggttgctcaaaggcagcgagctcactctgtggatgtggagaagaacagaaagatgaaggcttcctcctcagagaacccgtggatgacagaatacatgaggtgctattcggcaagagcttaaagaaacacttgcgtggacagcctcttttaaaaagtgtaaatgactgaaaggaaaaacaaaacaaaaaccatcaaaagaaacggacacaggtttaagaaaccaactgattatgcaaggttttttttagggaatttgtaaaagattgttttattttgatgaatattggtcacctacctcggcagtagggcagacagttgaagccatagacatttggttatttatgaagataattccctaaatctttgatattcttataaggtttttgttttaaagcatcttaatcttttaagatactgacaccaaatgcctttaaatggcaacagatgcttacagttcagtattcttttcataagcttaggtagagcctattatcatcttgttctaaataactttccagattccatagctataagatcattccatcctacagcataagactcgttttccttatatgccgttttgtttgtgaaagaatatcaagtcaaaaatgagtgtcagcactactactgattccatgtataatgaaagtagaactttgctagttcctgaaaatttttaacttatttgtatttcagttcagcagcatctttatgtagattgtgatatttaagaattatctgggctgggcgagggtctctttttctctttcagtgatcatctaggcagttattatttaatagtttaatagctcaagtacattccaatagacgaagtgcacacaacacaatatgtgtgtacagtagtagtaaagtttcttttgagtagtc

SEQ ID NO: 32632 - DNA, 1667 bp, Homo sapiens
ggaaggactaaggagcattttcgggtggagtaactcaaacagcaacctcctgcagctgctggaggatgaccacaaatccagatctttccgtgaaggaaagcaaaattgagatgattggatttatcttgggggattgcggagaaagcccttagggtgtggtgctgtctatcttttaacattccagatgctaagtctcagaatcggagtagcagtggttgcttttgaataagcttggttcaatcttggtatatttgttgttgattttaaaatgagataaatggtttgaaaattatgctaacttgttcctgtatttctactttaagtggatcgtatgagttgagccataagtgaaaatgttactgtcttaagcattatgatttttcaacataaatattttaattatatataaatctgatttcaaagtattttcatctcatttatctcttttcaaaagcactgccagtgaaagatgtagaagataaacctgaacaacaaaccagaacaagagagactgacaaatcacccaccagtactgagcctcgacagcaaccaagtgccttatttgctagaggaaacaggaaagcggtcaaaagtccccaaagatcatcgagtaaaataaaagaaaacaagcatccatttgctctttatggctggggagaaaaacagaccgatacaggaagccagaagactcacaacgtctgtgcgtccgctcctgtgcacgagattcatgaatcagcattacgagccaagaacagaagacaggtggaaaaaaggaaactggttgctcaaaggcagcgagctcactctgtggatgtggagaagaacagaaagatgaaggcttcctcctcagagaacccgtggatgacagaatacatgaggtgctattcggcaagagcttaaagaaacacttgcgtggacagcctcttttaaaaagtgtaaatgactgaaaggaaaaacaaaacaaaaaccatcaaaagaaacggacacaggtttaagaaaccaactgattatgcaaggttttttttagggaatttgtaaaagattgttttattttgatgaatattggtcacctacctcggcagtagggcagacagttgaagccatagacatttggttatttatgaagataattccctaaatctttgatattcttataaggtttttgttttaaagcatcttaatcttttaagatactgacaccaaatgcctttaaatggcaacagatgcttacagttcagtattcttttcataagcttaggtagagcctattatcatcttgttctaaataactttccagattccatagctataagatcattccatcctacagcataagactcgttttccttatatgccgttttgtttgtgaaagaatatcaagtcaaaaatgagtgtcagcactactactgattccatgtataatgaaagtagaactttgctagttcctgaaaatttttaacttatttgtatttcagttcagcagcatctttatgtagattgtgatatttaagaattatctgggctgggcgagggtctctttttctctttcagtgatcatctaggcagttattatttaatagtttaatagctcaagtacattccaatagacgaagtgcacacaacacaatatgtgtgtacagtagtagtaaagtttcttttgagtagtc

SEQ ID NO: 32633 - DNA, 622 bp, Homo sapiens
gaggggcggggcggcctctgtgtcgtgtaccgggtcccgtaggctgcgggcagcgaggagcggctggcgctcgaggcggcggacggcaccatgtccccggggagcggggtgaagagcgagtacatgaagcgctaccaggagccgcgctgggaggagtacgggccgtgctaccgcgagctgctgcactaccgcctaggccgccggctgctggagcaggcgcacgcgccctggctctgggacgactggggcccggccggctcctcggaggactcggcgtcgtcagagtcgtcgggcgccgggggccccgcaccccggtgcgccccgccctcgcccccgccgcccgtagagccggcgacccaggaggaggcggaacggcgggcgcgcggggccccggaggagcaggacgcggaggccggggacgcggaggccgaggacgcggaggacgcggctctgccaggtacccggcccggaggggagcgcgaggggcctgcacgcagggacggtttgctctaagctctgagcagctgatctcttatttcttgcgccactcggggctggctcttccttttttttttttcggttgacagaatccgtctctcttgacaaaatagggaaggtggca

SEQ ID NO: 32634 - DNA, 435 bp, Homo sapiens
gatttttactaaaggggttttttaaaagaagtacttcagaatggaggaaaatgactccagaaggaagatagaagatataaaaatgaaaactgaatgagaaattactaaatctaaaaaaattataagatttacatttaaatttagattaaaaataataataacaatatctaatttggaaggagagttcattttaaataaaagaactaactccttctgactattttgctttgttattggaagttaggaggtgagtgatcagagttcaagtattctaagggccttgtattttcaggacaggtgtaaaaatattcataaactttggactttgttgcatatgcatggtaaaatttcaaatattcttatttaaagaataaaaataagactaaaaacaaaaaactttacaaaaatcacttgtatttctatttaaaagccaaa

SEQ ID NO: 32635 - DNA, 331 bp, Homo sapiens
attttggccaggctggtctccaactcctgacctcaggtgatccacccgcctcagtctcccaaagtgctgagattacaggtgtgagccaccgcaccctgcctgtaaagaagtattaatagatgccaatgaacttcctatgtctgaacaaggaaatgataagtatatacaagttttaggaattcagagaagtccatattattctcaggtcaacaaattatttgtacaaggaatcagaattacagattctttttttttagtggttagaattgctttcacaggacatggccacaatttctgaatccccacctgggcgttaattggccagatggcc

SEQ ID NO: 32636 - DNA, 304 bp, Homo sapiens
ggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgttacctttt

SEQ ID NO: 32637 - DNA, 414 bp, Homo sapiens
tcgacgcttttgaaaacttgggtaggaccagggcaaagtggtgtgtttaatccagttgcatcacagcctcaggacccctgggaggaccttttggctgtcctgggatgtggagcatgaggctgcagcggctccactcttccgcagcctgctgtgcgcgctggctgccgctggcccttcacgcacgacgttcactagggtggcacgcacagtcttccagtgggtccaaaccactgagctttgttgtagtatggcagatcattagctgctggattttgctttttgtgatgatgtatcaagtagcataccaccccagaccaggaaagtagaacatgttagataattttaaagaagggggctggacgcggtgactcacgcctgtaatcccagcactttgggaggccaaggcgggcggat

SEQ ID NO: 32638 - DNA, 549 bp, Homo sapiens
  misc_feature (2)..(2): n is a, c, g, or t
  misc_feature (28)..(28): n is a, c, g, or t
cnttattaaaggggctactgaatgtggnaaacccacacaggtcccccagttcattctagatgactttatccagaatgccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagac

SEQ ID NO: 32639 - DNA, 557 bp, Homo sapiens
ttgtgaaagttgagaactttttctagttctggtttattattatacttggtttctagactataacagatgaggagtaaaaaattagaagtgctacttgagaaatgcattttggtagggaaaagaaatgatgtccagcatcatgatagtaaaggagggttatatttctactgttagaagcaataatttataaacttagttatgaggctatttagtttgggaatcagtattcccagagctgaatcagtagttatagaatgttcattattaattgatgattttattaatgattctgaatcagagaatattgttatatttaacctatttcagaagggaaatgagcgtgtgatttagtttagaaggatttctattataattttttcttttaggttttgaggcctatggaaaatttatgcattggctgcataccttgtttttcaagggagtcacatgtataaagaagcttgagaataaagttcctgccttttgagtttctaacagttgtggggcatattattgattgaaaaattaggtgatgttttaacattatttaaacagat

SEQ ID NO: 32640 - DNA, 135 bp, Homo sapiens
atgttggaaatacttggaaaacacttgcttttcctaattataaaatcaacaggtgagaattccattaaacgtaatgagtgaggcagattcacacattcttcaattctttaataaaataacaaaaataacaaaact

SEQ ID NO: 32641 - DNA, 405 bp, Homo sapiens
aggtcagaggataccattttcataatgtttttctcacttttcatgaaatttgaagaagcttaatttttatattatgaaatatttgttggaaagtgtttctattttaaatcaagattatttttaaagctgggtgccatgactcatgcctgtaatctcagtgctttggaggccaaggtgggaggatcatctgagcccaggagtttgatatcagcctaggcaatatagcaagaatgcgtctctacaaaaaaatcaaaaagttagccaggtatggtagaacagcctgtagtcccagctcttgggaggccgaggcaggaggatcacttaagcccggaagtttgagactgcaataagctatgatcatgccactacactccaacctggacaacaaagcaagaccctgtcttt

SEQ ID NO: 32642 - DNA, 819 bp, Homo sapiens
cactgtgccacgggaccctggtctttgaaaccttggcgtgcgcgagaatttcccagtgagtttgttaaaatgcagattcctcgggtctgcgtagacagactgtgccccacgcttttctaagtcagttgtttctcgggctaccctttaagagacactgctggatggcctggtgaagaaaatacagaaacagatgggtacaagaactaagaaaacggctaagaaagtgttttggtcctgactactaccatttcgctctgtgatttggggcaattcacattggcttccctgccctttcttctttgtcaaaagacaaaatcacaacaaatttagttcaaagattttttttttcttaagagacggactctggcaatgttgcccaggctggaaggcagtggctattcacaggtgcggtcatagcaatcatggctatcacaggtgcatcctggaactcctggcctcaagtgatccttctgcctcagcctccggagtagctgggacttaaggtatgacagagccaaaactccaagtcatgtcagtagggcatgcccaatagaaaatgctttgacatctaacaacacccagaaccaatgattcctccctgtggtaccaagaagacctagacatgatcggaacctaaatgctggaactctttcaggagcaaagggtctgttgaccagaaagatccaggggtaaaatccacctcaacatacccgtgtagtcaaatttgacaccctccaatcagaccctgccaagccaaaattcctaatacgtttccttgccatctgtattagtctgttttcacgctgctgacaaagacat

SEQ ID NO: 32643 - DNA, 325 bp, Homo sapiens
gtgtccttgttaagtcttaaacatgccagtcatgttcccccttagggcctttacactggttgctccctctgtgtagaatgttcttccctcagatatccatatggcccactcccacacttctttcaagtcttggttcaaatgtgaccttctcattgaaacctaaactgatgtctgtattttaaattgcagtattcaatcttccccctcaccatcagcctatcttagtacttaaaatcctttttaccctactctgttttatttgtttcttttgagatggggtctcactctgttgtccaggctggagtgcagtggcaggatcacagct

SEQ ID NO: 32644 - DNA, 405 bp, Homo sapiens
tagaattatcagcaatccctcccttgattaaatccagttttatcttaattctcaaccttaaaactcatgagttagaaccttatgcttgacccctcccctccagaatactcattcttctcataagcttctgtatctgtgctaccttgattctttcctttcagctatttttgctttttcaggctcactaggcaaccatgtctttttaaaaaataatagctttattgaaaggtaattcacaaaccataaaattcacccttttaatttgttcatcctgtgattcttagtatattcacagaattgtgcaatgatcatcactatctaattccagaacagttctatcactccaagaagagactcttacaaacaaactgtggtacatccctctggcagaatactatttagcag

SEQ ID NO: 32645 - DNA, 1843 bp, Homo sapiens
actgtggcgtgggagcatctacaaactcctgtggcgagagctgctctgcttccttgggttctacatggcgctgagtgctgcctaccgctttgtgctgaccgaagggcagaagcgctacttcgagaagcttgtgatttattgtgaccagtatgccagcctcatccctgtctccttcgtgcttggcttttatgtgacgctggtggtgaaccgctggtggagccagtacctatgcatgccgctgcccgacgcgctcatgtgcgtggtggcgggcaccgtgcacggacgcgacgaccgcggccgcctctaccggcgcacactcatgcgctacgcagggctctcggccgtgctcatcctgcgctccgtcagcaccgcggtgttcaagcgcttccccaccatagaccacgtggtggaggctgggtttatgacccgcgaggagcgcaagaagtttgaaaacctgaactcatcctacaacaagtactgggtgccctgcgtctggttctccaacctggcggcacaggcccgacgcgagggccgcatccgcgacaacagcgcccttaagctgctgctcgaggagctgaatgtttttcggggcaaatgtggaatgctctttcactatgactggattagcgtacccctcgtgtacacgcaggtggtgaccatcgcactgtacagctacttcctggcttgcctcattggtcgccagttcctggacccggctcagggttacaaagaccacgacctagacctgtgtgtgcccatcttcaccctcttgcagttcttcttctacgccggctggctcaaggtagctgagcagctcatcaaccccttcggagaggacgatgatgactttgagaccaactttctgatcgatagaaacttccaggtgtccatgctggcagtggacgagatgtatgatgacctggctgtgctggagaaggacttgtactgggatgcagccgaggctcgcgccccatacacagcggctactgtcttccagctgcggcagccttccttccagggctccacctttgacatcacgctggccaaagaagacatgcagttccagcggctggacggcttggatggaccgatgggaggggcgcccggcgacttcctgcagcgcctcctgccggcgggcgcgggcatggtcgcgggaggcccgctggggcggcgcctgtcctttctactccgcaagaacagctgcgtgtcggaggcgtctactggggccagctgctcatgcgcggttgtccccgaaggcgcggccccggagtgcagctgcggggacccgctgctcgaccccggcctgccggagcccgaggccccgccccctgcgggtcccgaaccgcttaccctcatccctgggcctgtcgagcccttcagcatcgtgaccatgcccgggccccggggtccggcgccaccctggctgcccagccctattggcgaggaggaggagaatctggcctgagatcttagagcccagccccctaaggacagggaaccaggtccctgcacggcacccacgcaggtgtcccggtctgcataagcctcgtatgcctttgtaaagtccacctacacttttgaccagctctcgctgcccgcatgtgtttggcgctgtgctaggggcgggagttcttccagactcttggaccagcccgccctgaccaccagctctacttcccaacccccactgcctgagaggtctctatcagtgtcctgcctgaattctttccttcaagtgaagatgtgactgactacctcctcgagttgtcatgaggatgaaagaatggcattaaagcatttggtatacagtaggtgctcaataaattgctagtgatttttactc

SEQ ID NO: 32646 - DNA, 398 bp, Homo sapiens
agtggtctgaagggaaaagctgatgtgttttgtcccccaaaagggatagatggcctcaaaggaaaatgtcgcatttggattagatttgtggtaggggaggagtgacctgccaagggctccttgaataaacaaaactgttcctcaaagggctttgggtggaggtcatcaaagcaagttcacagaaagatcctcctccctggtaactctccagagatggctgactctttgcttacataggtagctcaggggtcccacttgaagtcagttgcccagaataagccagagcctgccccctcaagaattcaggaatgtggtttccaatgcaaataaaggctaaattgtagaaacagtgctggagtgtgttcaagccctccctctaggtcctctgagtcatttgg

SEQ ID NO: 32647 - DNA, 498 bp, Homo sapiens
atatttaatttagttttaaaaatcttttctagattgggttagttctttggtagagggaaattgaaatgcataatttcgaagccttctcttttatcctccagaatagtctcccttgaacagcattcataaatggtaggattataacccacctgctaccgagtgatctttgttttgaacctgccactttgtattaaaagcaaactttttggccgggtgcggtggctcatgcctgtaatcccagcactttgggaggctgaggttggcagatgacgaggtcaggagttcgagaccagcctgaccaacaaggtgaaaccccatctctactaaaaatacaaaaaattagccaggcctggtgctgcgcgcatgtaatcccagctactcgggaggctgaggcaggagaatcgcttgaacccaggaggcagaggttgcagtgagccaagatcatgccattgcactccagcctgggcgacagagcgagactccatctcaaaaaaaaaa

SEQ ID NO: 32648 - DNA, 372 bp, Homo sapiens
cctggaccaggcctaggcaagtggggagaaaaggaggaaaatgccccaacaatgataatctctcctttctaaaacttggtgtgaagcattgtcatccctgttgtcagtaacacaagctgtcattctgcagagctagtttagccattccctaacagacagctagttaatagtctcccttctgtggtctagcttcaattatctattcctcagacattgctggtgggaatgtaaaatgttacagccacttgaaaaacagtctgatagtttctcaaaatattaaacatagacttaccatgtgactgagcagttattcctaggtatatgtatttccaggtatagatcctaaagaaatgaaagcatacgttcaaacaa

SEQ ID NO: 32649 - DNA, 505 bp, Homo sapiens
aattagccttttcgcttcaaaaatttcaatgtcatgacagacaaaaactgagaaaacaaaaaggattaagggagcaaaaggacaaaataactaaatgcattcaatcatggacaggggaaaattattgggaaatggatgatatttgaatatgaactaagatgagatcacagtattttatcaaatttaaatttcctgaatttgatcattatatggggatatacaagagaacaatcctcatttttaggataaatacattcaagtattatttagggaaaaagacaaagtctacatctagctctcaaatgatcaagaaagaaataagtctacaacagtaacgtgtttgtatgtgtacgtaaacaaatgtaacatagtgttaacaattgtggaatctaagtaagggtatataagagtttaccaggccgggcacggtggctcacgtctgtaatcccagcactttgggaggctgaggcgggtttgagaccagcctggccaacatagtgaaacc

SEQ ID NO: 32650 - DNA, 302 bp, Homo sapiens
tttttaataacttttttctagactcttacttataggattcaattggactgcaaacattttaaaatttataatttaaatgtaaatttcagcttcaccctgtctgaataatcacagattgcatataagaagattcaaattaatgaggttttcttttctaagaactactaagctaatataagaaaaatgtatacatagtataaattaaaagaacatacgggtttggtttttttttttttttgagacggagtctcactctgttgcccaggctgcagtgcagtggtgtgaactcggctcactgcaac

SEQ ID NO: 32651 - DNA, 639 bp, Homo sapiens
gacatttttcacagaaatagaaatagtaatcctaaaattcatgatatcacagaagatactgaatatccaaagcaatcctaagcaaaaagaacaaaatgggagtcatcacactacctgaccttgaaatatactacaaagtgatggtaaccaaaacagcatggttcaggtattttttaaaaaccacacaaaccaatggaacaaaacagagagcccaggaataaatcccatttacagccaactgatttctaacaaaggcacaaagaacattcactgggaaaaggacagtctcttcaataaatggtgctgggacactggatattcatatgcagaagaatgaaagtagactcatctctcaccatacacaaaaatcaactcaaaacaccaagtatgctggctcatacctgtaatcttagctactcagaaggctgagttgtggctcacttgagtccaggagttcaggaccaagctgggcaatgtggtgagactatgtctctaaaaaataattaaaaagcaaaaacaaaaattgggaatgtatttttagggcaatttgaatctatgctctcaggataatcaactcaaaatggtttgaaagcttaaatgtaagagcaaaaactatgaaactacagaagaaaacatagg

SEQ ID NO: 32652 - DNA, 425 bp, Homo sapiens
tagagatgagggtctcactatgttgctcaggttggtcttgaactcctgggctcaagcaatcctcttgcctcggtctcccaaagtgctgagattataggcagaatccaccgtgcccggccctggggccatttaatgacacaaagtataacatcaaagcaggttaaaaaaaaaaaagatgcagttttgaaaaataagctcagaagaaaaagagtaaataatcagaaagccactgtagcctggtggttaagagcaagagtgaggctgggtgcggtggctcacgcctgtaattccaacactttaggaggctgaggtgggaggatcgcttgggcccaggaatttgagaccagcttggtcaacatagcaaaaccccatctctacaaaaaaacaaaaaaatatgctgtgtgtggtggtgcatgcctgtggtc

SEQ ID NO: 32653 - DNA, 101 bp, Homo sapiens
taaaagctaatgaaaggaattcatttcttaaagtgaaactcatatttctgatttttacatttcctttctcagagaaggaatgcaatggtttgaatgtttat

SEQ ID NO: 32654 - DNA, 484 bp, Homo sapiens
aatgctgaaactctatagcaattaaataactctccatttttccttcttccaagcccctggagccaccattctactttctgtctctatgaagtctgactgctctaggtacctcatgtaagtggaatcatacagtgtttgtctttttatgattggcttattttacttactataatggccttaaggctcatccatgttgtagcatgtgtcacaatttcctttttaaggtggaacaatatactccattgtaaatacacacaccactcatctgttgatgaacacttgggttgcttttgcctcttgtgaataaggctgctatgaatataagtgtacaactatctctttgggaccctgctttcgattcttttgggtaggaacccagaagggcactactggatcatatggtaattctgtgtttaattttgaggatcacttgaactcaggagtttgtggttccgtcgacgcggccgcgaatttagtagtagta

SEQ ID NO: 32655 - DNA, 527 bp, Homo sapiens
tacaagacccagcctgatcatagtgcttgggaagccatccctgactttctctgccaggttgtgtaaagatgcccccctgcagagcacccttcattgctctgtacatctcagacatgtaataactgttctattacatgtctttcttccccttagatctagggtctggagggcagagtctgtgctacacttttctgtttattcaactattcacaattgttggtacacagtaagcttgcaatacatacttttattgatatgtcataatattgtctaaggcaatgaatccccaccttagctgcatgttagaatcacccggacagcttttaaaaatcgaagtaacatcttggcacagtggcgggctgtagacccagcttcttgagaggctgagcggggaggattgcctgagctcagaattcgaatgtagcctgagcaacatagtaagacctcttggtctctgaaaaagaaagaaagaaagaaagaaagagagagagagaggaggggagagaggacagaaagagagcaaagag

SEQ ID NO: 32656 - DNA, 92 bp, Homo sapiens
agcttaatgggtatgtagtgcgtctaagattctcttgcacaagattaaaattgttgtacatgttaaatgtttccagatggagaggcctccac

SEQ ID NO: 32657 - DNA, 340 bp, Homo sapiens
acagtctataaccaagtaacttacctactaacttatctagttacttgttacttgttatctagtaacttgttacgttattgagcactcatttatagtacttgctctgagtctgtgaggaggaagtctttaggagaagcagggattatcagaacaatttacagttgtgctttaatggacaaaaccaaaacatgattacaatttgacaattttgtttatatatagtgcttagtatatttatataaactctctagagctgcactatctaaaatagcactagagacacgtggttatattagttggcttggactgccacaacaaaatacaatagactcgatgtctt

SEQ ID NO: 32658 - DNA, 504 bp, Homo sapiens
aactccggagcttaagtgatcctcctccctcagtctcccaagcagctaggactacaggctccagccaccatgcccagctaattttttgaatttttatagaatggggtctctatgctgcctaggctggtcttgaacttgtggcctcaagggatcctcccatctcagcctctcaaagtgctgggattataggtgtgagccactgcatctagcttgttaataatatcttgataacaaaaagacctcttaaagtgtttaaagtccataataaggccaggcatggtggcaggcacctgtggagctactcaggaggctgaagtgggacaattgctcgagcccaggagtttgaggctgcagtgagctatgttcgcaccactgcactcgagcctgggcaagagcgagtggaaaaaaggaaaaaaaaaagtctataatataaagtttattttttatcagagtacatttatttttagccagcctctaaactcatccagagccacatacacgctg

SEQ ID NO: 32659 - DNA, 1409 bp, Homo sapiens
ttggggatcctcactgagcacttgctggctgtcctgcaccctgcccggtgtgggtggggcgatcctggacatgctcccagacccaacttgcgcccagccttgcctctgtgcctgctctgtaggcatgtctcctccgcagagtcttgttggcaaaaagataccttttctaggaaaacacgttctctggagcaagttagctaaagtcagtttccagtttgtacctttcacatggtcttccccagactaaaaacagtgcatcttttacatgatatttttgtactgtttaaatcactaatgctaccagttatttttggtgaacttgtctctgtagagtggaggagataagggcatattaggtgcaaacaaaggggaggaggattgtgttaaaaaaataaaaataaaaaaatgatcaggatagggtgaggacagagtcctgatgtttttacccaacacatttattggcccattagtcaaacttttaataaaagagtatgaagccagcatcaaaaccaaccagttttgttgttgcccaacccaccttaatccacatttccattttgtctgagacacagtgtgaaggactctcagttgccatattaaaaatccagaaccttgacctgggcatggtggctcatggctgttatcccagcactttgggaggccaaggtgggcggattacctgaggtcaggagttcaagaccagcctggccaacatggtgaaaccctgtctctacaaaaattagccaggcatgatggtgggtgcctttaatcccagctacttgggaggctgaggtgggagaatcgcttgaacccgggaggtggaggttgcagtgagccaagatcgcaccactgcactccagcctgggcaacagaacgagactgtgtctcaaaaaaatccagaagctttatcccaggtctactggacttcctagaacaccaagaaaggaaagggaattcgcctgtcatgatttagaatcatgggggaatattgtactacccaaataatgagtgacaaaaaggtacctccttgtttttaagccacaacttgaagcagttagcaaggaggtctattttggtgagaaagttggtgggttccattttcaacatgtgattcaaattacttaatacaggctgggacagggagaatgtgagcagctgatattccagctgagattaggggtccatttgtagagatggttccagaagaccaaaactatggaaagaatgacagggtcaaagtggaggagctgccggggacatccagcagtcagagaatttctgaattgaaaacatggccaagcgcagtagctcatccttgtaatccccacactttgggagaccaaagcagaaggatcccttgaggccaggagttcatgaccagcctaggaaatacagcaagaccccgtctc

SEQ ID NO: 32660 - DNA, 213 bp, Homo sapiens
atgtccaacaacatggccaagattgccgaggcccgcaagacggtggaacagctgaagctggaggtgaacatcgaccgcatgaaggtgtcgcaggcagcagcggaactcctggctttctgcgagacgcatgccaaagatgacccgctggtgacgccagtacccgccgcggagaaccccttccgcgacaagcgcctcttttgtgttctgctctga

SEQ ID NO: 32661 - DNA, 510 bp, Homo sapiens
tgccagatcttgtacttttgcattggcaataggctgggcattaactcatgagcttggagaaaaatgacgatttgtcagggtaggttatggggagaatccctctataaggcaactgtagtacagtaatttaaagatgatttcaggtagtaaattcaggtttcctcagacagagaggggccagaatgcttctaccagtaagggagttttacgttatttgagggttcagtttctcagcttcaagtgtcctctacccaatttcagggtttcagtgtgtctccatcacttcctttatctaagcatcagagacctggtgaggataagcatttaacttgggctgcaattctgcaacccctgaaatccgactgtgggcctgatcctcagttttatcttcctcatagaggttttcagactttgcatcctagtttgagttagactgacaaagtcaacattcattttagggtcaacagaagcaaccagcttatcccacaatccttatattgactatgatct

SEQ ID NO: 32662 - DNA, 870 bp, Homo sapiens
agcggagggggtgtagtaatttgtcctcagaccacaaagagatggttttacatccctaactagctgcatagaaagctgggagctgaaccagcatgccatactgccacctacctacagcagcgctgacagttcttcagctcagcccgcaaaccagccagcatctgccctgtgcccggcaatgagcccgctccagctgggaatgcccaggtcctggtctaactgagaagcttgtagcaggggaactttgaacctggctgcctggaaacttggaagcaacccagatgtcttcagtaggtgaatggataaataaactgtggtgcatcccaatattggaatatgattcagcactaaaaagaaatgagctatcaagccatgaaaagatatggaggaaatttaaatgcacattatttaagttaaggaagacaatctgaaaaggctacaccctgtatgagtccaactctatgacaccctggaaaaggcaaaactacggagacaataaaaagatcaggggttgccaagggttggatgttggggagggatgaatagatagaacatagaggattcttcagacagtgaaactactctgtctgatactataatggtggatacacagtattatacaatcatccaaacccgtagaatgtacaacaccaagactgaacctccaactcctggggctcaagtgatcctctggctcagcctcccgagtagctgaaactattgggtgcacacgaccacatctggccaatttctacaacaatttactatagaggcaggatctcacctatgttgcccaggatagtctcaaactcctggcctcaagccatcctcctgcctcaaccttcaaaagtgctgggattgccaccaccc

SEQ ID NO: 32663 - DNA, 500 bp, Homo sapiens
agcggagggggtgtagtaatttgtcctcagaccacaaagagatggttttacatccctaactagctgcatagaaagctgggagctgaaccagcatgccatactgccacctacctacagcagcgctgacagttcttcagctcagcccgcaaaccagccagcatctgccctgtgcccggcaatgagcccgctccagctgggaatgcccaggtcctggtctaactgagaagcttgtagcaggggaactttgaacctggctgcctgggttgaaaatcacacaggatggaaagagaagtgttctgcaggcaacttctgctctcagcctggctgcagagctctctccttgggcaaaagccacagcacctgctctctccttaggggccagggagtgaagacaaagggaaaacacagcaagaaagaaagaaatgtgtgacctcaaagacaatccatccagacatatttgtgtgtggtatctacacattacatcgctgaaaaatgatgaa

SEQ ID NO: 32664 - DNA, 506 bp, Homo sapiens
gaaaagaagaaacgccctatagaaagaaaagcaatactgtttctattacacaaaaggatactgggacaagggacatctggagcccatgatgtgggcagctaagcaggctgcggctacagaacaactgcaggccacacagtcaggagccatcacagtcaccaagcgccaatcacacatgaccacctattaaaccacaatgacactaatcgctgtgccatctatacggaacactcccccacataaagcagccacagtccttatcaacagagatccagactgaaaaatccatctccccaagccctcactcagggaaaactactgcccagcaccttcccctcacaactttttgtttaaaacgaaatattcaagcataagctacttttaacttcccccttttacttaaaccaagtgttatgagattaatccccccaaattaaccagaatgtaatactacataataattacccagaaagcatgatattccagctactgggtatgttttaacg

SEQ ID NO: 32665 - DNA, 3724 bp, Homo sapiens
ccgccgcggtcacagccacccgcgggaagctcgtggccgggaccccgaggcgggagcgcgggctgggccgggctgggccacgcgcacgggctcggccgccgcccctgccggttgcataccctgtcctgagggcgcggcacggagtgcatgcgggccgctgccatgacgaccgccatcttggagcgcctgagcaccctgtcggtcagcgggcagcagctgcgccgcctgcccaagatcctggaggatgggcttcccaagatgccttgcactgtcccagaaacggatgtgccccagctcttccgggagccttacatccgcaccggctaccgccccacggggcacgagtggcgctactacttcttcagcctctttcagaaacacaacgaggtggtcaacgtctggacccatttactggcagccctggccgtcctcttgcgattctgggcctttgccgaggctgaggccttgccatgggcgtctacccactccctgcctctgctcctcttcatcctgtcgtcaatcacttacctcacctgcagccttctggcccacctgctgcagtccaagtcagagctctcccactacaccttctactttgtggactatgttggcgtgagcgtttaccaatatggcagtgctttggctcatttcttctacagctctgaccaggcctggtatgaccggttctggcttttcttcttgccagcagctgccttctgtggctggttatcttgtgctggctgttgctatgccaaatatcgttaccggaggccttatccagtcatgaggaagatctgtcaagtggtgccagcaggtctggcttttatcctagacatcagccctgtggcacaccgtgtggcgctctgtcacctggctggctgccaggagcaagcagcctggtaccacaccctccagatcctcttcttcctggttagcgcttatttcttctcctgccccgtgcctgagaagtacttcccgggttcctgtgacatcgtgggccatgggcatcagatcttccatgcatttctgtccatctgtacgctctcccagctggaggccatcctcctggactaccaggggcggcaggagatcttcctgcagcgccatggacccctatctgtccacatggcctgcctctccttcttcttcctggctgcctgcagtgctgccaccgcagcccttctgaggcacaaagtcaaggccagactgaccaagaaagattcctgaggctggcaagtggggcaacgtgtggaggaagcccctcataatttggagaaaacttgatacaatagaagctgacttttaaggcattggcttttaaattaatacatatatccaaggatatgttatagctgcagtgtttgaaagccaaaggatttaagagttttgttgttgttaataaaaggaatactccttttccttttggatcatagcttaacaaggcacaggaagggaagggatcttgactaagattcatgagacattgaattaaggagaatcatcttcatgcctgaaaatttagcaaaattccgactatggcctccaggggcaattcctaaaagctgaatggataataaaattggactggaaagtaagtaggtggctggtcctcaccctgttggaatggctatcctactatgctgttctttggtaatggaataaattgacccaaggaccgaatttcatttggatttcaaattgtccagagtggaaaagccttcaagatgacatgatgaattactcagttcatctgatttctggtccctcctttctcgacaactataatactaacccttttctcaggataactgtctacacctggcagttttctctgacgtgctgttcactcacatccctaccttgcatggtaatataaaggactaggaagcagtcatacttccaggaaatgcttggattcatgtggacattcaggaagcttattctcatataatactaatctaaacagtactagaaattacagtgccaagagccaccaggaggcccagccaataagcatagatactatatggtatcatgggacccatctattttttaccagtggactacaggattacttgagagttatcagggctgcctaacagaccaggagatctgggggttgcaccagggaatcgccatatttgaccagcatgttttaaaagctcttggtaggattagttggttctaaggatccctctagggacctcattatttcaagaggaacccaaagtccagcctcctacatagatgctgccccacgaaggacccacaaaactaacctagttcagggttctcaggcaggcagttctgcttcagcttagagcagaacccataaaatactcaagtactgggataggcaagcatgtgtgtttactgtggattggtccctgaaggctcctttgggtgagaacatgtgaaccaggcaccctggtttgtttggagcattgctgcccagaagcttctatgggataggtggtgcttgggattgatgtgttgtggccatgcagccctccctgaggattgacttctgcactaatccagtgaaggaggctgtgtcaaaagaagggctcagaagccctcttttcagaggcaatgattcctgtcagtatgaggtcccttagttactaaaaagggacatgatttaactccagtttgatgaacctcctccgagtttactttattgtcttcaaatcttttgttttcttcctttttgtgagatttgtgggttttgtgccttataaatggaaatgtatgaacacaatatatgctcatgtagaattttctgttctgggttattgggataagaaaaaatatatattgctcttcaactagtgaatgaaagaaacttcagaaagctagaattgcttatcaatcaaaagactttctcaatctattttggccacaaacaaacatattcaactgaagctttccaataatctttatatcaagaaagcatgcgtcttgtcagctacattgttttcttagatggatttctcctgttaatcctcaaatatctgaacttctgtgttacccaagtgtcttatacaagcttctggtgtctaggacaaatttatggcaaataaaattagcaaaactgaactgggttgaactgaacaagaggatgggggaattgtgcaaatacattgttagtagaaggtcaatttaaaatagggactagaaattatttgaagttttctttattacggattcaaagacttattttgaaagttggaaggagaagggagggaagagagcagaagggaagaaggtgtaagtcaagctcttgaatataactggtggtattgtgggcagagatctttagttcaaatccacgtattttttaaaagagagaaccggaggtagagcaatgatcagatgggtgcacagaccagtgccaatctgaacattgttaatggcctgtgacatgatgagcacaggaacaggcatgaagatattgccatacaattttaatttatacaagtattggcccctcaagtggttggaaattttttttttaatctctttttctgagacagggtcttactctgtcgcccaggctggagtgcagtgatgcaatcacggctcactgcagcctcgacctccccagctcaagcaatcctcccacctcagcctcctaagtacctggtactacaggcgcgtgccaccacacctggctaatttttgcattttttgtagagacagggttttgccacgttgcttaggc

SEQ ID NO: 32666 - DNA, 392 bp, Homo sapiens
acaaagcaaaagcaaaacatgcctgtagccacattaccccttcccgccaagacagtgtcacaggaaccatattcatttgcacacctagggcaaaaaccccagtcaaatataagaagtaatgatttccaagaccatgagcatcaggcaacaaaggacagtgatcctgagctatgagaaatgaaggaggcaagccctgtcattgccccagcttactgtcttgagagtttccaggctgtggtgccaggagggtggcctagatagccgacccagaggagagaattgcagaaagaaagatctccagagatgtgcccaccaccctgggacccagcagcgtactgaccagcccgtgtaagtaaccaagactggaggacaaaaagggggatgctaagatc

SEQ ID NO: 32667 - DNA, 347 bp, Homo sapiens
gaagggcctgagagtggacagagagacacaggcaagggagagggaggaaacaaaggggagggagaaaaacagccaaaagagttcatttaacttgagtttctctgtccaagaggaatgagccattgggaatatactggataccattgaatacttccagctgcaaaggatttatcagtgaggagctctcagctgctagtggcagagacctgatttaaaatcaggcttggctgggcatgatggctcacccctagactcccagcactttgggaggctgaggcaggaggattgcttgagcccaggagttttttgagacgagtctgggcaacacagtgagaccgcgactctac

SEQ ID NO: 32668 - DNA, 413 bp, Homo sapiens
tctgaaggcacacaaataatagcactggcaaatttgaatagtttcccttgttaccaaatctacgttcttatttctaatatggaacgattatttctagtatggagagaaatatggaatttctaatatggaagatttagcatggtgtgtcattgtaaaaatttaggcagttcttggataagtatgtccagccttccagagactataagtgtagtaatattagtgcctgttagtcatattgtgtatcttcctgatacccaattagatctctgattgttttttctttttaattaaaaggagctgaaagatgactcagttaagaagctggaaaataaaaccaggtctctgtaactgtgctgtcttattctgaactgaaagtctttctgcaataataatgatggtgataataaagctaa

SEQ ID NO: 32669 - DNA, 368 bp, Homo sapiens
tttttgacacagtatctcattctatcacccaggctggactgtaatggcaaaatcttggctcactgcagcctcgacctgagctcaagtgatcctcccacctcagcctcagcaccaccacccccccaacatcccattaggtgggaccacaggtgcatgccaccatgcccagctaattttgtatattttgaagagatggggtttcaccatgttacccaggctggtttggaactcctgggctcaagcaatctgcccacctcagcccaacaaagttctgggaatacaggtgtgagccacggagccaggcctataaatgcctttttcttttttaatctcaaaccacctaactcaaaacttcaaggaactagaaa

SEQ ID NO: 32670 - DNA, 517 bp, Homo sapiens
gctccctctactttttcctcgtcacctttcctaccctccctcaggccccaccaaagacacctagaagatttcataacacattcatactgagatcaccagagtcagtgcatctctgcttccggggataacaaaattttaactcaggatgaacccttaagggatcaagaccctagaggtagaatttagggttgggaacccctgaggcctcctcaaggaggcagctgtgctgcagtagaaaatgcctgaccaggctgggcatggtggctcaaacctgtaatactagcactttgggaggctgaagtgggtggattgcttgagctcaggaggtcgagaccagcctgggcaatatggtgaaaccctctctctaccaaaaatgcaaaaaattagctggtgcctgtagtcccagctactgggaggctaaggtggaaagattgcttgagccccagaggtggaagttgcagtgagccaagatcacgccactgcattccagcctgggtgacagagcaagacccatgtc

SEQ ID NO: 32671 - DNA, 649 bp, Homo sapiens
tcattaaccctcagacaacaaattaacttaatataggtatgtatcaaagcatgccaattcaagcaaaatacaattgaacaagcgttgcaagattataacacagcctctgatacactgtaacaatcaatctgtgttacttccaaaaggactgtgatccttttagactatataaagcaccactattttaaaaaaaaaacttccaattttggaatagttttttttttttcctccttaggatttaaaaaatccttggagaggcgggagaaggttaggcaatccgtgcttcaaatgcaatgcgcacacacatgcagccgtgtacttagttactgctgcaaacactgggcgacccagcgtagtcagtcagcactggggcaaggcttgacccattgtttttagtgagtatcaatgaataactggcatgcataagtcacctcttggtttgctgaggtcaggagcagccaaagattcttttggtggcagagtagaaaaaaaagaaaacatttgtaattaaaacagtcggctgaaaaggcaataaaggtaagtacacagaacaatgaaaactgcttacagaggcccaatcagccatacagcatgtccttacgccagtatctatgacaattccaaatggctgagaaatgtatgtaccaca

SEQ ID NO: 32672 - DNA, 378 bp, Homo sapiens
tgcctggagccaatccattgaaagtccatagatttcaggtgaagactctcaggcagtgactgtaaagaatgccaagattatacccaagacccatatatgcccctcacagcaacaataataaacagcccatctctgttcattagcatttttcttgaaaacagtcttgcctctgacaattatctatgtgtgaacttaagcaagactaaccttttccgagccccagttttttctctgtaaagtaggagtaataataccaaccttgcaagattgttgaaagtttagcaataataaatgtaaagttcctagcattatagtagggcactcattaaattacgtgtgtgtgtgttccttatcatttggaaaatacagaaaattaca

SEQ ID NO: 32673 - DNA, 274 bp, Homo sapiens
tggaacctctgctcttgggaaaggctttgatagctttctcttaaatactagtgttcctgatgggagaaatttaacctgaagcatcctctctgactgcaatgaaggtgttgtcctgttagaactgcactcagagcactgtaaagaattatataagtagccatcaccttaaccacatcctcaaacattttcaatgcaatctagcggagaatgattttctgaaagaatacatatctgattttataacagaaataaatggaaatatgatttgttttat

SEQ ID NO: 32674 - DNA, 426 bp, Homo sapiens
tttttttaagccatcaggtttgtggtaatttgttatgatggccccaggaaactaatataattgcattgcggttacgtcaaagaatgttcttgtttgcaggaaatacacactaaagtacataggagtgatagacataatgtcagcagcttaccctcaaacagttcaggtgttttgaactgtatttacacctctattataatttttaaattgttttgaaattttaaaactattttaaaacattactagagcagttgccagatcatggaggttagcaagattgcaatttcccaagaccactccaagccatgccttggtgatggcccagactccaaaggatatgggaatcacagagtataaataaagagtaataaatcaagtgttggagtttgccttccaatatgtgtctgcaattctagactatgcaaa

SEQ ID NO: 32675 - DNA, 3402 bp, Homo sapiens
cgcgggcttgcgggcaggggctgcagggaggaggagaggacccgcgcccgcgggggctgggcggaggcggggccgggcttccggacagaggccaatcgctgccctcggggcctccagcgccggctctgggccgaggcagccagagcgcggaagaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggagacagagtttcaccatggtgcccaggctggtctcgaactcctgaggtcaagcaattcacccacctcagcctcccaaagtgctggaatgacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagtgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttgcagccagcaaataaagtcgaaagtgtctcatccgaggaaaccttcgaaccaagccaggaactccctgctgaggctctcagggaccccagtctgcaggatgcactggaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatcgttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgatgctcgtaggatatttcaggtgagtcagggttggatggtcatcggctttcagagggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacaaaaaaaag

SEQ ID NO: 32676 - DNA, 3273 bp, Homo sapiens
ggggaggcaacatatctaggtagaggccgggtgttaatcggccgtcgggtggtgtcccgggggcgttgtcgttgctgggcgcatgggtgttaagacgcagcggggtcgcaggtgactgtggggaggacagggggtcaaggggcccctggccagagggcacgaggctgacctggagcgccaaggaggaagtgcggggcgtggaggtcgcaggggcatcgggggaggcaggggccccgtggggcgcaggtgacatggagtgggtaggaggccgggggtgacaccggcggggcctgcagccgagggtgtcgagactgccacgctgtcgcccccaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagtgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatcgttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgatgctcgtaggatatttcaggtgagtcagggttggatggtcatcggctttcagagggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacaaaaaaaag

SEQ ID NO: 32677 - DNA, 3030 bp, Homo sapiens
cgcgggcttgcgggcaggggctgcagggaggaggagaggacccgcgcccgcgggggctgggcggaggcggggccgggcttccggacagaggccaatcgctgccctcggggcctccagcgccggctctgggccgaggcagccagagcgcggaagaggcctggaaatccacgcggattcccggagacggcgcctctgctctgcgggttcgtggcgaggaagtccacccactgctcccgggcgcaggtctgcagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagtgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatcgttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgatgctcgtaggatatttcaggtgagtcagggttggatggtcatcggctttcagagggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacaaaaaaaag

SEQ ID NO: 32678 - DNA, 3096 bp, Homo sapiens
cgcgggcttgcgggcaggggctgcagggaggaggagaggacccgcgcccgcgggggctgggcggaggcggggccgggcttccggacagaggccaatcgctgccctcggggcctccagcgccggctctgggccgaggcagccagagcgcggaagaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagtgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatcgttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgatgctcgtaggatatttcaggtgagtcagggttggatggtcatcggctttcagagggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacaaaaaaaag

SEQ ID NO: 32679 - DNA, 3453 bp, Homo sapiens
tatggttattgttttctttttttaatgaaactagatcactgcttacaaaaccctgcacaagccctcctgcccatccccttcacagttcccttggctcagcctctcctgtctcacaggaactgcaacaaaatgggtgtggaacagccaccaccacgtccattgaacgacaggaaggaagaggccctgggctcccaccctgggccttaagagggtgacagttcttccttccacatccgttcccatggggcctggagttgcatggatgagggtggtccatgccaccatggttctcaggccaccactcagaccagagaaagttgacaaagacaacgaagacttccaaaagtgtatccattcacaccggaattctgcgggttcgtggcgaggaagtccacccactgctcccgggcgcaggtctgcaggtccgcgcccactgcccgcggcgccactgaccatgtcggccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagtgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttgcagccagcaaataaagtcgaaagtgtctcatccgaggaaaccttcgaaccaagccaggaactccctgctgaggctctcagggaccccagtctgcaggatgcactggaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatcgttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgatgctcgtaggatatttcaggtgagtcagggttggatggtcatcggctttcagagggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacaaaaaaaag

SEQ ID NO: 32680 - DNA, 3309 bp, Homo sapiens
cgcgggcttgcgggcaggggctgcagggaggaggagaggacccgcgcccgcgggggctgggcggaggcggggccgggcttccggacagaggccaatcgctgccctcggggcctccagcgccggctctgggccgaggcagccagagcgcggaagaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagtgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttgcagccagcaaataaagtcgaaagtgtctcatccgaggaaaccttcgaaccaagccaggaactccctgctgaggctctcagggaccccagtctgcaggatgcactggaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatcgttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgatgctcgtaggatatttcaggtgagtcagggttggatggtcatcggctttcagagggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacaaaaaaaag

SEQ ID NO: 32681 - DNA, 2620 bp, Homo sapiens
gcttcatcgaacaccttcgagaggatgaccctgagcaggctggacacctgaggagtgatcaacaccaccagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagtgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatcgttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgatgctcgtaggatatttcaggtgagtcagggttggatggtcatcggctttcagagggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacaaaaaaaag

SEQ ID NO: 32682 - DNA, 3378 bp, Homo sapiens
ggggaggcaacatatctaggtagaggccgggtgttaatcggccgtcgggtggtgtcccgggggcgttgtcgttgctgggcgcatgggtgttaagacgcagcggggtcgcaggtgactgtggggaggacagggggtcaaggggcccctggccagagggcacgaggctgacctggagcgccaaggaggaagtgcggggcgtggaggtcgcaggggcatcgggggaggcaggggccccgtggggcgcaggtgacatggagtgggtaggaggccgggggtgacaccggcggggcctgcagccgagggtgtcgagactgccacgctgtcgcccccaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagtgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatcgttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgatgctcgtaggatatttcaggtgagtcagggttggatggtcatcggctttcagagggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacaaaaaaaag

SEQ ID NO: 32683 - DNA, 1849 bp, Homo sapiens
ggggaggcaacatatctaggtagaggccgggtgttaatcggccgtcgggtggtgtcccgggggcgttgtcgttgctgggcgcatgggtgttaagacgcagcggggtcgcaggtgactgtggggaggacagggggtcaaggggcccctggccagagggcacgaggctgacctggagcgccaaggaggaagtgcggggcgtggaggtcgcaggggcatcgggggaggcaggggccccgtggggcgcaggtgacatggagtgggtaggaggccgggggtgacaccggcggggcctgcagccgagggtgtcgagactgccacgctgtcgcccccaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagtgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttgcagccagcaaataaagtcgaaagtgtctcatccgaggaaaccttcgaaccaagccaggaactccctgctgaggctctcagggaccccagtctgcaggatgcactggaggtggtatccaaattcttccccttgcccaaggctcccggtgggggccatccaccgtcactgaggtcaactgcatgcacacaacagctgttaatttttcagcctcatttaacaaaaaataagaatcggcttccctcttcc

SEQ ID NO: 32684 - DNA, 462 bp, Homo sapiens
tgatgtttgtcgatttacttccactccaggcttttggttattttaaagtttatttgttttcaagcaatggtgatgacaaattggaagatttaaatgttgttatctccattatatctatcaggagtttaatatccctaggggatcttgttacaatgacaccagaaggaggtcagaacatatacatacatatatacacatattttatacatacatataaaatatcccttctctttttctttaagtagcaaaactcttcactgtaaaaaaattattccattgaggtaactgagttttctagacatagaggaatgatgtgtgaaaataacacaatttaaatctgtcatgtaataacttggatcagttttgaagaaatttgtcatgttcagtgcactgtttttctgggagacagatctacaatagttgatatttacgcagtattttcccattaaacctgataagaaa

SEQ ID NO: 32685 - DNA, 351 bp, Homo sapiens
ggaggcagaggttgtggtgtgcggagattgcgccactgtactccagcctgggcaacagagtaagactccatctcaaaaaaaaaaaaaaaaaagaaagaaaggaagggtggtgggtggaaaacagcatggagaagggaaacaagtgggccagagatgagttaaaaaaaatttttactgagtgaggaataggaaggaatttccataaactcaaaaaaagtgcatccatgaataatctgtaaaacatgatacttaacggtgaaactttagaacagtattaaacttagaataagctactatcgggccgggtgaggtgactcacacctgtagcattttgggatgccgagatgggga

SEQ ID NO: 32686 - DNA, 736 bp, Homo sapiens
atcagggagttttatgagaaaccctagctcctcagttccacagtgggtaactgtaattcactctaggtctgcgatatttcctgcctatccattttgttaactcttcaatgcattccacaaatgcctaagtattctttaataatggtgggtttttttttttgcatctatgaagttttttcaaattctttttaagtgacaaaacttgtacatgtgtatcgcacaatatttctagtcgacagcactgctttacagaatgtaaaccgtgcactcccaggaaaatgcagacacagcacgcctctttgggaccgcggtttatactttcgaagtgctcggagcccttcctccagaccgttctcccacaccccgctccagggtctctcccggagttacaggcctcgctgtaggccccgggaacccaacgcggtgtcagagaagtggggtcccctacgagggaccaggagatccgggcgggcagcagctgcggaagagccgcgcgaggcttcccagaacccggccggggcgggaagacgcaggagtggggaggcggaaccgggaccccgcagagcccgggtccctgcgccccacaagccttggcttccctgctagggccgggcaaggccgggtgcagggcgcggctccagggaggaagctccggggcgagcccaagacgcctcccgggcggtcggggcccagcggcggcgttcgcagtaggagccgggcaccgggcagcggccgc

SEQ ID NO: 32687 - DNA, 357 bp, Homo sapiens
gtatcttcataagaacctctagtgacctttatcagagaagtatgttaaccattaaccagctgtgtgacctcaggcaaattattaaacttgagacaaagctttctaattcaatgatttaagatattcagcaagttatcagtagtatttagagaacctacaggttcaggagaaaagcaggaagcctcaagagacccaatcccggaaataagcactaaagcagaaacagcttgcttatattaataagcctgacttcaaatattttcgccacattctcgaaattaacaactcattttgttcagatgaaattctaccaattaagagaattggcttattattttaaaatgtatattattctga

SEQ ID NO: 32688 - DNA, 753 bp, Homo sapiens
caatgagctgattatagttgagcaaattgtatgaaataaaatttgacaaaattagatgggactggattgtaggaaaaagtgataggctgacaaaaagtgcactttatattgcatgcaatgagatgaaatactcggaggtattttggttgttacaaagatggaggaagaggacactattagcatttaatgagaaaggatcagggaagtcagccatcccacaatgttcaggacagtttgcacatttaagaattgttccaaatcaccacatgacctagaatgacttgctggactttgatgatgtaggttaaaaaaaaaaagtgatcataatgatgtgagcatagacagtaactccattttgtgtatgaggcacttttttgttgttgttgttgttgttgttgttgttgttgttgttttgagacggagtttcgctcttgttgcccaggctgaaatgcagtggcaccatctaggctcactgtaactgaggcacctttaatatacactaagattttcaggaattcagttaccacaatattggaggaatgttaaagtttttgttcagaactttatcaggagtactccacccctttagaaaatcacgtaattgatggcagtgtcacttgtgctgtattggtgacgcaaatactcttcagtctgcagttgtaactgccacagtcacagtgcttgttgtatatatgtacaaagtaccatcagtgtgttatttattatagtaatagcctaaatattataaaattg

SEQ ID NO: 32689 - DNA, 384 bp, Homo sapiens
ggggcattaactctgcatctctcttctctgaaagtatttattttgtttctgagtccagcagtttttttgattctttctctttatatttttctgcattgctatgtgttggacgctggcatagtcttttaatgtatatatttactggttaatgttgacctttttttcataaagatgatatataatatatatataagtttatttgagactaaattgacttaggaaaaagacacaaatgaaagaaccatagtttatattaaaatgtaaaacgtgtttatcaaaaagcatcataaacagaattttaaaattatttgccacatatttaagcagacattaatttatttaatatatagagtacatttgttctaagaaaaacaaactctctag

SEQ ID NO: 32690 - DNA, 1075 bp, Homo sapiens
tcagttctgtgacgtgcccaaaatcacacgaagcgagttaatcacagacccagattttctcattcgcagtatgctgcatacttgtccatactaaattatctttaaacagtgacaaacatttaaaagcagatttgggagccacttgttttgctgtggagcctggaaggctgattcataaggaatttcaaataatggcagtgaccatggcctcattagccagcttggtccccctcagtatgacgaagaaactggactgagagaagaaccccaggttgaagagaactctctgtgttctgcacacctgtgctgctgaaaatacagacaccagtgaggccctaaagagagtaagcgaaccaggaagagaaaaaaatcacacagatgaatcctcgcagcctgaagggcatttggcacagaaggtgtctcaaaaagtcagctgagggaacatccagatgtcacgcaaaaggatgttttctcctgaatgaagacttacgatatagatgagagttatgaagtgactaaaatgagaagtaatagtaagatatggggaattagaatgaagtcaataacctcgaacttggcaactggaagtcctggctatttgggaaaagtagtcctttgttaaacttggacaagttgttccttttaatgtgccccatttccaaaaatattgaatttctttacctttcattcagcaaaagcagcagaaacttttgcttaaacgtttccttgtcttttgccacttggaggtgttgcttgaaatgctctcatcctccggggttacctttcgtcaaaggaagctgcatgaacgcatccgtcactcgcagctatttcagggctagcttgttttaagttaggggtgataacagatataggcagaactttgcaatgtaaatgtttagtcttatttgggcactgctgaatttgtttccgagcctcgtcttgtgattttaatttctggcttgtctcctgaaaacaacaaaaatgagctctttggttcacattttcagtggctttggtttgcagaaatcataaataaaagtaacttacatggaacagaacattttaacaaacaagg

SEQ ID NO: 32691 - DNA, 583 bp, Homo sapiens
gcttacattttctggttgaaaagtactgctctgttctattacattcatctgtttgcttatcctgtgtcaataccacactatctcaactgctgtaaattataatacgtctacatatcatggataagtctccaattttggtcatcttcttagagactgtcttagccattcttgatactttcatttccatatacattttagaatcagcttgtcagacttcacaataaacaaaactggctgtgatagtactgaattcataaatcaatttggaaagtactaatatctttacattactgagtcttcaataaacatagtatatccttctaattatttggttttttaaaagtctatcgatgtttatatctgtgttttattttggtagttttatacttttcattaggtatttttcatatccttctgtagattatttttcaaatctcactttctaattgttgataatttacagaaatacaattaatgtttatatactaaatttatacccaacaatatcactgaatatattttttagttttcagttttactgatctacaatattcaataaactgaacatgtttaaaggaaacag

SEQ ID NO: 32692 - DNA, 298 bp, Homo sapiens
catcctggtaggtatggtttcaattatgttactagattagattatattttttgattactagatgatttaacatcttttcctgtgtgtattagctcttctgttttccacttctatgtattactgtttaaatttgcttcaatgtgggattatggattgatttttagtctcttttaataagtaggaggaaagccctttactataactgtctaatttcactacatagcacacagtagtacagctgatttggggcattaactctgcatctctcttctctgaaagtatttattttgtttctgag

SEQ ID NO: 32693 - DNA, 347 bp, Homo sapiens
aactatcaggatttgtgaaaaatacaaggtacaaaatcacgcagtttataaaccacagattgtcttgttattcccatcagtgaaaagaagctgatatttgtttgtgtttgtttttgtttttgtttttgagacggagctcggctctgtcgcccaggctggagtgcagtggcgccattttggctcactgcaagctccgcctcccggttcacgccattctcatgcctcagcctcccaagtagctgggactacaggcgtccgccaccatgcccggctaattttttgtatttttagtagagacaagagtttcaccgtgttagccaggatggtctcatctcctgatcttgtga

SEQ ID NO: 32694 - DNA, 398 bp, Homo sapiens
cgtcgaagtcaagattgatcagaggtgaaacctgaatttgcacagagaaacaatgtggtatacacagagatagcctcctatgacttcatctacatttttaaaagcagtcatatgggctggacagagtggctcatgcctgtaatcccaacactttgggaggccgaggcgggcagatcatgagatcaggagttcaagaccagcctggctaacatggtgaaaccttgtctctactaaagatacaaaaaattagtcaggtgtggtggtgtgcgcctgtaatcccatctactcaggaggctgaggcaagagaatcacttgaacccaggaggcagaggttgcagtaagccaggatcgtgccatttgcactcgagctggggcgacagggcgagactccgtcttaa

SEQ ID NO: 32695 - DNA, 522 bp, Homo sapiens
cgcgtattcagactcagaagaaaagctttaaagatcaagtatcctgacatgtccacaaatctttgtatttaaagataagcttgagataagtaagctaaactagattcaccaaagacagagttaagcctaagcttctttctagaataaagatgagagaaatgaaatcaggaagggtgcaatgttatcattataaagaagagcttattaccacaacattatgggggcagctgtttcattaattcctaaggctgaatgcaggagcccatctaaacactgcatttgtcataagtcatacagatgaacaccgtactccaaacatggctgaccgaagtacttagtttctttacagtttctccctgggtgatctcatccgttctgtgaccttaaatcctttctagatattgataaactcttaaatttacatccttagctcagacctctcctctgagccctgatttacagatctaacttcttgctttacatcacttcttggaaatctaacatatttaaaacagcttttgc

SEQ ID NO: 32696 - DNA, 412 bp, Homo sapiens
ccctttcccacatttgtggggcggaacccgtccctccctcttggaccctgcgcgctgccgggcccgggctagtgcttccctctcgagcccctgcagtgcaccttcccggggttccccggatgcgggcaccgtctgcgttcagcttgacccctttttctccagcattcctttctccttctgttacaccactactcacagtgtagcagctgcaacaatgcttagcacccaaggagccgcctccaggcgctgtagaggcgcgggggtatagctcagtggtagagcatttgactgcagatcaagaggtccctggttcaaatccgggtgccccctcaatggcttggtttttccttccccttgttaaccatctgtttttcattcttgactcacattttaacattgggtcctgactaaa

SEQ ID NO: 32697 - DNA, 413 bp, Homo sapiens
gaaaacaatttagtatcatctataacctggcaatactacttctaggtatatattctgagaaacgctttacatttaaaaattattgaggacctcagggagcttcagtttatatgagttatattttttgaaattttccatattaaaaattaaaactgactgggtgtggtggttcatgcctgtaatccagcattttgggaggccaaggtgcgaggatcactttaggccaggagtttgagaccagcctgggcaacgtagtaagaccccatctctacaaaaaaatttttaaaaatagctgggcttggtggcatgcacctgtagtcctagctactagggagactgaggcaagaggatcacttgagcctaggagttcaaggctgcagtgagctatgattgtgcctttgcactccagcctg

SEQ ID NO: 32698 - DNA, 379 bp, Homo sapiens
acagtcattcaccaaatctgtaagaaaacatcatgagctgtttccaggctgaattagagctatgacttcatgcagctgcctcactttcagacaagacagtttcagtcagatgatcttgctggccagaaaaggggagaaactctcctatcaacaagctactggccattggccaacctggtcatctctcaatagtgacgcaggtttagagctactcctggaaaagcagctgtcttcaaaggatatgaaatgagctcatgcatgaaataagacttgagcagagatgtgattctgtttatgtaattgctttaattaataccctctccataagccattccagtatattttgcttatgaaaattaatacttttaatgttatgaga

SEQ ID NO: 32699 - DNA, 1143 bp, Homo sapiens
  misc_feature (502)..(502): n is a, c, g, or t
atggcgtcccttcctgtcctgcagaaggagagcgtgttccagtcgggagcccatgcctacagaatccctgccctgctctacctgcctgggcagcagtccctgctggccttcgcggaacagcgggcaagcaagaaggatgagcacgcagagctgattgtcctgcgcagaggagactacgacgcacccacccaccaggttcagtggcaagctcaggaggtggtggcccaggcccggctggatggccaccggtccatgaacccatgccccttgtatgacgcgcagacggggaccctcttcctcttcttcattgccatccctgggcaagtcacggagcaacagcagctgcagaccagggccaatgtgacgcggctgtgccaagtcaccagcactgaccacgggaggacctggagctcccccagagacctcactgatgcggccatcggcccagcctaccgggagtggtccacctttgcagtgggcccggggcattgtttgcagcttnacgacagggcccggagcctggtggtgcccgcctacgcctaccggaaacttcaccccatccaaaggccgatcccctctgccttctgcttcctcagccatgaccatgggcgcacgtgggcgcgagggcactttgtggcccaggacaccctggagtgccaggtggccgaagtcgagactggggagcagagggtggtgaccctcaacgcgagaagccacctccgagccagggtccaggcccagagcaccaatgacgggcttgatttccaggagtctcagctggtgaagaagctggtggagccgccgccccagggctgccaggggagcgtcatcagcttccccagcccccgctcggggcctggctccccagcccagtggctgctctacactcaccccacacactcctggcagagggccgacctgggtgcctacctcaacccgcgacctccagcccctgaggcctggtcagagccggtactgctggccaagggcagctgtgcctactcagacctccagagcatgggcaccggccctgatgggtcccccttgtttgggtgtctgtacgaagccaatgattacgaggagattgtctttctcatgttcaccctgaagcaagccttcccagctgagtacctgcctcagtga

SEQ ID NO: 32700 - DNA, 1947 bp, Homo sapiens
taatttttaatccttttcaaatgtttgtgccatttacatttgatataatattaaaagcagtattattgaggtattagacagtaaaccgtgacacagactagctgtgaagtagagattgggcaggacctacaggtcctctgatacactgtgaacgcgtcactcttctgcccaacttcatagcctcctcttgctggcctcctatctgtatgcttggttgcctctgccctgacttctctgtagcccttgcttctttttcttctttctgcttcctctttgatcccaatggaaggttctcaaaaaaacagttaagtggtagtatttattttttccccagaaactgcaagagatatcacaagcattgccttatttaatttatgacaacctggaaagtaacgatgagattctgaaaggttaaagacctcgcgcagtcacacagtatggcggcagagctaggtctgtgtggctccaaagcccaagctctgaatccatcttctgttctgcttcacttccttgtatcctcatgtgctctgttgcctgtcttcccttaccctacgaagctccccatcttagagagacctttcttttactctgttccttttcattcctttgatattttgtctccttcccttcttccttaaattttgaatacatgtagtttaagcttgtactcttcatttgtttccattccttcttgagtctttttccattttctgtctctactactaaaactgcttgctttaaatttaccatggccttgccaccagatccccctctcgatttctgtactatgtacaacttgaatgtagtactacatttgagaatgtttttttagaaatatagataataaaatccttcacagtgccaaaaaagctaattaatatttggtgtattgttattttttcttggcagttctttttaaagcttgattttattcataacgtataagcaatgttgtcttctgcttgtttcacttaaaggaatagcatttttcatattgctgcataattttcatatctgttataatgattatataatactgcatccccaaaactaccattcacttaatttgaataatttactgtatgaatgaacattatggctgtttcccttttaaattgatgctatgataattctttgaattggcctattaatcatattagagttaatttttaattagagaagctgtagtagatctaacgtgggccagtacctatcagagtggtggtggaaatggaaggaagccagattacactgggaagatagcagggtttgtgtcagattaattataaggagtgagaagagaatagttgaaaatggagctctaaatggcatcagttttattgcttttggctataagttgagatgccaccttcaaccattaacttaaaaacacaacaccttgtttacttttgctttacgcatatttgaaaatttacttctagatattctgcctcacatttctagttaggatacctccttcctatagaattttgcactgttggctctattgtttcaaaaaccaaaaacaagcatattattccactaccaccagcacctcccccccacatatttagaccagcagtctgggttttgcccagtgagctcctttcctactttgcaatgtaaaggtcaggttctcatgagatctctggcaggctggtgttgggccaggcgccatggctcacacatgtaatcccaacactttgggaggccaaggcaggaggatccttgagcaccaaagttcaagatcagtctgggcaacacagggaaatcccatctctacaaaacagaaaaaaggtagcagggtgtggtggtgcgcacctgtagtcccagctactcgggaggctgaggtgggaagatagcttgaatctgggaggttgaggctgcagtgagctgtggttgctgtactctagcctgggccacagagcaagatcctgactaaaaaat

SEQ ID NO: 32701 - DNA, 556 bp, Homo sapiens
gcctttagcattctcattgcagaatttaccgtagcagatattaactcactcttagggtagagactaactttaattagaagcagtacaatattatttctagtttacttataccattttgatgtgatatgctgatggtaatacccttagcccttcccacagtgtgtgtatcctctcttaaaaggcacatcaaagagctgagttagctttccatataatcctatattgaattagtagaagcatcaagatgttcaaagaagcttcaacaactttctaactgacatttgttgttctttgggtcctatagattattcttggtcttgaaagcttagtaggtgtcactcagcatacatttagacagtgtttccaggagcattagagatgaaaaaaggaattttctagttacacaatattctgttcactttttgataaaatctaatatagattatttacgtagatggattataaaatttaggcagtagattttagtctaaaagtcaaatcataatatgaggcactgtgatctgggaataaaggaaactttaatattcatgagcca

SEQ ID NO: 32702 - DNA, 483 bp, Homo sapiens
agtgaaagacccccataaggaagattataagatactgatgaaagaaactgaacaggatacaaagggaaagacatcccaagctcatggatcagaataattaatattgttaaagtggcagtactctccaaagcaatctacagattcagtgcaatctgtatcaaaatacgagtgacattcaaaacagaatgtcactggaagaaaaaaatctggataggcaaggtggctcacgcctgtaatcccaccactttagaaaaccaaggcaggagatcacttgaggccaggagtttgagactgtcatagtgagatctctctacaaaaaaatgcaagaactagccaggtgtggtgtcgtgcacctatagtccaagctacttgggagactaaggtgtggggatcacttgatccaggagtttgaggttacagtgagctatgaccgctactgcactccagcccaggcaacagaacaagaccctgtttcaaaaaaaa

SEQ ID NO: 32703 - DNA, 614 bp, Homo sapiens
acataatattctatagagtattaaatgagatactagccctaggcaggtcccattttcttatcaacttctagaaactgtcataaagaggactgcatctcccacagcaacactgtaattgggagttgtattcctcatcaaggacaagatggcaacggtgatatgggagggggacagggaagtgctgggtagagaagggcagggtcactggcaagggctccaccctcaggcttgtgcccatggacctaatgagaacaaggactcctgtcttcttgcccaaatgttgcattttccaagaccactctggcctgccatgccacccattctgtgcctataaaaaccctgagaccccagcgggcacacacacaagcggctggacgtcaagaggaacacactggcagaagaacacatcgaaagacgctggcaggccattgatggtggaacgattcggacgccaagggaaattcggccaaggacagtaggagatcccggctgctgagcagccagactccagaggaagactaccttcccatgctatcccccttctggctccccagccatctgctgagagctacttccaccactcaataaatcttgcattcattctccaaaaaaaa

SEQ ID NO: 32704 - DNA, 3039 bp, Homo sapiens
tcactttcgagagtgccgtctatttgccacacacttccctgatgaaatgtctggatttggactaaagaaaaaaggaaaggctagcagtcatccaacagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggagccagaattgtgccagaaacttcccatgttaaaagttttgaacctccagcacaatgagctatctcaactttctgataaaacctttgccttctgcacgaatttgactgaactccatctcatgtccaactcaatccagaaaattaaaaataatccctttgtcaagcagaagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctcttctaggaaaatgtgtctccttatttcaggcctatttttgacaattgacttaattttacccaaaataaaacatataagcacg

SEQ ID NO: 32705 - DNA, 3217 bp, Homo sapiens
tcactttcgagagtgccgtctatttgccacacacttccctgatgaaatgtctggatttggactaaagaaaaaaggaaaggctagcagtcatccaacagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggagccagaattgtgccagaaacttcccatgttaaaagttttgaacctccagcacaatgagctatctcaactttctgataaaacctttgccttctgcacgaatttgactgaactccatctcatgtccaactcaatccagaaaattaaaaataatccctttgtcaagcagaagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctcttctaggaaaatgtgtctccttatttcaggcctatttttgacaattgacttaattttacccaaaataaaacatataagcacgtaagaacattgtctactgattaatatacaatcagccactgagcctatgacagcttaaggagtttgaaaacattcctcattttaagaaaagttagaggtatatgagggtttgtgatgatctttttgtattttggatgcacttagaatgaaagataattgtttcaatgggtataatgcta

SEQ ID NO: 32706 - DNA, 2712 bp, Homo sapiens
gacacaaccaggaactgccccaggagtgacttcacgagcagtttattcattgcaattgttctcatggtgataaagaaaaagtaccaggagatggatcctggactggaaggtcagagaagcctccctgaaaaggtggcatctaagctgaggctgtgaatgctgagcagaagttagcccgtggccaggggaggtcagaggctggagtaagaggtgggcgctgcaggaaccgattttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctcttctaggaaaatgtgtctccttatttcaggcctatttttgacaattgacttaattttacccaaaataaaacatataagcacgtaagaacattgtctactgattaatatacaatcagccactgagcctatgacagcttaaggagtttgaaaacattcctcattttaagaaaagttagaggtatatgagggtttgtgatgatctttttgtattttggatgcacttagaatgaaagataattgtttcaatgggtataatgcta

SEQ ID NO: 32707 - DNA, 625 bp, Homo sapiens
agcggcaccaagacacaaccaggaactgccccaggagtgacttcacgagcagtttattcattgcaattgttctcatggtgataaagaaaaagtaccaggagatggatcctggactggaaggtcagagaagcctccctgaaaaggtggcatctaagctgaggctgtgaatgctgagcagaagttagcccgtggccaggggaggtcagaggctggagtaagaggtgggcgctgcaggaaccgagtaaggaaggactcgtgcattacaggaagggggagaaatgctctgcccatgggatgtggtgaagggtgagcggagatggagtaaagaactgcatctggccgggtgcagcggctcaggcctataatcccagcactttgggaggctgaggcgggcggatcatgaggtcaggagttcaagaccagcctggcctacacggtgaaaccccgactctactaaaaatacaaaacttagctggacgtggtggcgcatgcctgtaatcccagctactcgggaggctgaggcaggagaattgcttgaactgaggaggtggagtttgcagtgagctgagattgcactgctgtactccagcctgggcgacagagcgagactccgtctcaaaaaaaa

SEQ ID NO: 32708 - DNA, 542 bp, Homo sapiens
taaattctgctcctgggaacagttcccttaagcagttcctgatttttgcatctttaacacttcttttaaattaattatcatctaattttttaacatatctgtactttcccatctctcaagtttcttagactctactgaggtcagggttgagatatataaggcttctctgattcaagggcactggggaagaccagtgcaatgttgcgacagaggtatccatttctatatacagtcggccccattttaactcactgtaacaccagatacatttatataatgtgaggctttctccttcagagcaacaggatattctgtgaggtatttggcagtgataattagaaactgcaggtaaacaatgttgctgccagttccgcatctgaaagtagaactcccaagtcattggtgtactggggaggtgctgacagttaaaacctgcttagatgggcatggggggagaagtaccccaaagttgagggagctcacatcaatcctaagctaacatattcacccccaacacatgccccatctttttaaaaaaaaaa

SEQ ID NO: 32709 - DNA, 920 bp, Homo sapiens
aaacacaattgtgtattgtcatgaggcatccctgattaacccaggttgtagtagaacaagcccagagctgatgctttctcttagaaaccagagagatgaatgtgactgacgtttttctttctccctctcatttttcttttttttaagagacaggatcttgctctgctgcccaggctagagtgcagtggtgcgatcatagctcactgcaacctccaactcctggcctcaagagatcctcccatttcagcctcccaaagtgctggggttataggcatgagtcactgcaccaggcaagacttggtttatctgtaaaacggagagaatagttacagtcttgtgaaggtcccaaacctgtgttgtctagtacaatagccactagctccctgtggatgcttaaatgtaaacgttttagaacgaaagcttcagttcttcagtggcactggccacaagttaagggcttgataactgcaggtggctggtggctacggcattggacagcacagaagagaacttcccattatggaaaaaggttctgtgggacagggctggtgtgaggcaggtacagtgcccagtccttggttaggacatgtaaggccagctgtgattataattatgatcatgatcctgattcttcgtgaactcccaaatctaggcccattacaagggtgagggaagtgagaagagggctttgaaaaaagaaagaagaaaagacaaaataattgtggagtttttgctggtgaagagatgagaactgaggtagcacaacctcagctccccactgcagaacagaagaaagagacttcagggaaaaacagtcttgctctgtcactcaggctggagtgcaatggcacaatcacagctcactgtagcctcaaactcccaggctcaagcaatcctcctgcctcagcctcctgagtagg

SEQ ID NO: 32710 - DNA, 339 bp, Homo sapiens
ggaatgctttgtcggtaaggggtcacatgcaagttgcaaatacaaggatgtacaaatgcccaggaaagacctgggaaggtcctatgtgtccacctcagattgaccttgagcctctgcacaagcaggaagtgatagccaagatagaggtgtccactgcctgacttgaatgttgaaggcatgcccgaacaagcacataaagcttccagcaaagactaggatagttattagtttcaggcatttaaggatatctcagttcaataattagacagctaataagctaactcagcagagactttagtgactacatatgtatgacaaagaatgcagattttacagaat

SEQ ID NO: 32711 - DNA, 210 bp, Homo sapiens
atatggccatccccaccacacctcaccctcaacccacttccacctccggaggaggaagcttttcagtagcttcacaagagttggctttgcaggcctgcgtgagctcaatagaagaactggctgacactggctgctgcgccccggaggctctctctttccagaaatgccaagttcttgagcaaggagctgccaccattacagcaccacata

SEQ ID NO: 32712 - DNA, 346 bp, Homo sapiens
caaccttactcatggactcaggtcacatgaaatgatatttatctctgataatagaccttatcttgaagtctactttgtttactattacgaatattgccactccagttttcttatgattagtgtttacatgatacactttctgcagtttcacctttcatggtttcagttacccatggccaatagtggttcaaaaatattaaatggagaattccagaaataaacaattaaattttaaacggcatgctgttctcatagcatgatgaagtctcatagtgtccttcccaggatgtgaagcaccccttgaccagcatatcagcactgtacaggctgcctgccagttggtcac

SEQ ID NO: 32713 - DNA, 469 bp, Homo sapiens
gcctgcatgtctgccaagttcaagacctggtttggccctggggatctaggaatatccaaatgagacagaccttgaatctcagggttggttgagtttcagggtggtgacatgagatttatggcttgaatctcacagagttgtgacatgaaaagtattctctccacttggagaagtgtttcctcatgtctcccactggcttgggtaaaatattacctgtgatgatttcaccccgctttgctctgacttcacactcatgaagaagtcgctattgactacgcagcttcctaacatcctggcttggggaatgggaggtgccctggttgggaatgagagttctccaggcactgaagatggagagcatttattctatcttaattggcactagagaaggcatcagtctcttgtgcatctgtgagttcatcaatcttcctgatacctgtcgattctggacctcccaagatccaatttc

SEQ ID NO: 32714 - DNA, 463 bp, Homo sapiens
ctgacgggccagtgagcgggcgtcgggagtgggcggatgcgttggggttcgggtcgtgggtgttgaggcggagaggaaggcgtggtgtggcgtctccaggtgattgcgattgggggaaggtagaggagccagagaacgactcagccgtttcgggggaagaggaagttggacaacatcggctgttttagtgctttttatttttccccaattcagcagagaatattttcaaggggggtgagttataatgacctatcgcgttttactgagcccagttccactcccgcccttccttggctttgtagggtctcccctccgctccctcggaagcgcttctaagaaggtgggcagagggggggaggtttgctaccaacagctcatgaataattcatgagccccgcccttcgtcaggaagccccgcccctccggatcgcgctgacgcacgctgcgtttaccaaacttaagg

SEQ ID NO: 32715 - DNA, 3281 bp, Homo sapiens
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggccccca

SEQ ID NO: 32716 - DNA, 3321 bp, Homo sapiens
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggcccccaaaaaaaaaaaaaaaaaaaaaaaaaaaaaaaaaaaaaaaac

SEQ ID NO: 32717 - DNA, 3227 bp, Homo sapiens
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaagggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggccccca

SEQ ID NO: 32718 - DNA, 3361 bp, Homo sapiens
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggcccccaaaaaaaaaaaaaaaaaaaaaaaaaaaaaaaaaaaaaaaaaaaaaaaaaaaaaaaaaaaaaaaaaaaaaaaaaaaaaaaac

SEQ ID NO: 32719 - DNA, 3290 bp, Homo sapiens
  misc_feature (3267)..(3267): n is a, c, g, or t
  misc_feature (3269)..(3269): n is a, c, g, or t
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcataaatcgtggagaaataaacccacaagggaacntntattgtcctatggcaggtcat

SEQ ID NO: 32720 - DNA, 3323 bp, Homo sapiens
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcacgtttattcaggacactaacctctatcttgtagggctgtggttcttcaaaggacccagaccctaatattccgggggggtccacgtccca

SEQ ID NO: 32721 - DNA, 1765 bp, Homo sapiens
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacgggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggccccca

SEQ ID NO: 32722 - DNA, 1886 bp, Homo sapiens
ctgacgggccagtgagcgggcgtcgggagtgggcggatgcgttggggttcgggtcgtgggtgttgaggcggagaggaaggcgtggtgtggcgtctccaggtgattgcgattgggggaaggtagaggagccagagaacgactcagccgtttcgggggaagaggaagttggacaacatcggctgttttagtgctttttatttttccccaattcagcagagaatattttcaagggggtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggccccca

SEQ ID NO: 32723 - DNA, 1825 bp, Homo sapiens
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggccccca

SEQ ID NO: 32724 - DNA, 3393 bp, Homo sapiens
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggtaaggctggtttattttgtcagggaggctggtcctggctgaaagagtgcagacccccatggggattcttgaggtgctgccaaccccttctgatcactctctctcccctcaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggccccca

SEQ ID NO: 32725 - DNA, 3227 bp, Homo sapiens
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaacctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggccccca

SEQ ID NO: 32726 - DNA, 3065 bp, Homo sapiens
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctcccccagtgggagagggggttgggttttcaatgtgagaacagcacaataaacttgatgtctagggcagtggccccca

SEQ ID NO: 32727 - DNA, 2703 bp, Homo sapiens
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgcgacctatgagggatcctctgatc

SEQ ID NO: 32728 - DNA, 1059 bp, Homo sapiens
gaagagaaagactcttacggaaacgatctacaagaactactaccgaatccaattgaagccagagcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggccccca

SEQ ID NO: 32729 - DNA, 2520 bp, Homo sapiens
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaaaaaaaaaaaaaaaaaaaaaaaaaaaaaaaaaaaaaaaaaaaaaaaaaaaaaaaaaaaaaaaaaaaaaaagaggggggggaaaaaagggggggggagaaaaaaagaaaagaaaagaaaatagaaaaaggtaacacacacaacatagaaaaaaaggagaaacgcagggaaccaaaaaaaaaggaaaaataaaaacagaagaacctaattgcaagagaaagaga

SEQ ID NO: 32730 - DNA, 2405 bp, Homo sapiens
gcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggactggcagggaggcacgcaggtactgtgaaaatccttccctttgccctcccccagtgggagagggggttgggttttcaatgtgagaacagcacaataaacttgatgtctagggcagtggccccca

SEQ ID NO: 32731 - DNA, 890 bp, Homo sapiens
cgcagtctgcgcagggactggcgggactgcgcggcggcgactacagacgtgtcgggggtccggggcctgtcgcggttgccaagcgctcggcgcctggcgctggcgctggccaaggcgtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggtagaaaattatggcatgccgtttagcagaactgaagatgggaagatttatcagcgtgcatttggcggacacagcctcaagtttggaaagggcaggcaggcccatcggtgctgctgtgtggctgatcggaccggccactcaatattgcacacctcatatgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacaggagtcaagaaacttttcttttgagctattgacagctttaacaagttattatactcctatgaacaaaatttggagcatatggttctctctgcctgatttctcctgaatttggaaactattttgaccatgaggattctcaacctgatcaaaatgagctttcctaaataactcaagaccatctgcttagaataaaccatccagctgggagaagc

SEQ ID NO: 32732 - DNA, 1020 bp, Homo sapiens
cagcagaatggaaaacgtatcccctaaatggctggccaaccttagcatatgggacagtgtgacctctctcacacagagccactaaaaactaaacactaaaaccagttttcttgagtaaaggtttctaagatggaaaatttaagcagcgagatatgtcaagttgtagacgttggccaggaaaaagccagcagcaaccaggcaggggagagtgtgcatccgacatcctcctgtgtgatgaagggatgacacctcttccctctgggctgtcagcctttactgttgcaggatacagatctcctgattcaggtgtccagtgccttttgaactgaccgcaagccctcctggacgattggaactgtaatgtggaaagggctctgatggagccggttaaaatgcttcattatttgcaaaataccacatacagtaatacgatctggatgtctttcccctcctccactaagtagcataagtgaagacttcccagaggaagtgcgtctttttcatctcgtatctgagtcaatgatatcctttttggatacaagcgtcatcctggttttctagagtgccaagccagggtggaaaggaggacctgggggctcagtccttccttgccccttgggctgcccttcagggttaagtagagggtcccagctgagctctctggattgcacaggagcacctgggtacataagaaggtgaacagtttgcaaggggaagtttgaattactatcccccacagcatttgttccttcaggacactaaccctctggatctgtgtcttctgtgtctccagtggcccaacggtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagccattacagccatttagaagatcctgg

SEQ ID NO: 32733 - DNA, 366 bp, Homo sapiens
aaaggatgtgtgtgggtctaagatatgtatataatagaaacatttattcagaagctttagtcaagacttcatttttaagttcagagtaataaactcatagtctaaatttcctaatttttctgtttaatttacataaataaaatgaaatgcaaaacaacaggtctaaaagttaagcagttcttggtatggctgcttctatgaattaaaagtttacaaataatattttgtgccacagtcaacgcaaaatcatgctgccgtgttccgtgtgggaagcttgttgcaagaaggttgtgggaaaatcagcaagctctatggagacctgaagcatctgaagacgtttgaccggggtgagcagacagtgggctc

SEQ ID NO: 32734 - DNA, 299 bp, Homo sapiens
caggtagggcaggacgccttgcccggaaggcgttcggctcgtgtgtcttgtaagcgtgtggtgcctactcattgctcttccatagttttatgtaataacatggttttgaagatcagcttccatagctctcaggtcctaacttcaatgtcatttccttaaggagacttttcccacactccccttcccctaaggcagtttgggccaccatcttatgcatttctcaagagccctaaaccctgccttggtgatacttatgccagcagtaaagcagggattgaggccgggcatggtggctcaca

SEQ ID NO: 32735 - DNA, 1591 bp, Homo sapiens
cgcagtctgcgcagggactggcgggactgcgcggcggcgactacagacgtgtcgggggtccggggcctgtcgcggttgccaagcgctcggcgcctggcgctggcgctggccaaggcgtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggtagaaaattatggcatgccgtttagcagaactgaagatgggaagatttatcagcgtgcatttggcggacacagcctcaagtttggaaagggcgggcaggcccatgggtgctgctgtgtggctgatcggaccggccactcaatattgcacaccttatacgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggctactggcgcaactacttgagctgcacgtctgcccacaccagcaccagcgacggcacggccatgatcaccagggcaggccttccttgccaggacctcgagtttgttcagttccaccccacaggcacatatggtgctggttgtctcattacggaaggatgtcgtggagagggaggcattctcattaacagtcaaggcgaaaggtttatggagcgatacgcccccatcgcgaaggacctggcgtctagagatgtggtgtctcggtggatgactctggagatccgcgaaggaagaggctgtggccctgagaaagatcacgtctacctgcagctgcaccacctacctccagagcagctggccatgcccttgcccggcatttcagagacagccatgatcttcgctggtgtggacgtcacgaaggagccgatccctgtcctccccaccgtgcattataacatggacggcattcccaccagctacgaggggcaggtcctgaggcacgggaatggccaggatcagattgtgcccggcctgtacgcctgtggggaggccgcctgtgcctctgcacatggtgtcaaccgcctcggggcaaactcgctattggacctggttgtctggtcaggcatgtgccctgagcatcgcagagtcgtgcaggcctggagataaagtccctccaattaaaccaaatgctggggaagaatctgtcacgaatcttgacaaattgagatttgctgatggaagaagcataagaacatcggaactgcgactcagcatgcagaagtcaacgcaaaatcatgctgccgtgttccgtgtgggaagcttgttgcaagaaggttgtgggaaaatcagcaagctctatggagacctgaagcatctgaagacgtttgaccggggtgagcagacagtgggctc

SEQ ID NO: 32736 - DNA, 1692 bp, Homo sapiens
cgcagtctgcgcagggactggcgggactgcgcggcggcgactacagacgtgtcgggggtccggggcctgtcgcggttgccaagcgctcggcgcctggcgctggcgctggccaaggcgtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggtagaaaattatggcatgccgtttagcagaactgaagatgggaagatttatcagcgtgcatttggcggacacagcctcaagtttggaaagggcgggcaggcccatgggtgctgctgtgtggctgatcggaccggccactcaatattgcacaccttatacgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggctactggcgcaactacttgagctgcacgtctgcccacaccagcaccagcgacggcacggccatgatcaccagggcaggccttccttgccaggacctcgagtttgttcagttccaccccacaggcacatatggtgctggttgtctcattacggaaggatgtcgtggagagggaggcattctcattaacagtcaaggcgaaaggtttatggagcgatacgcccccatcgcgaaggacctggcgtctagagatgtggtgtctcggtggatgactctggagatccgcgaaggaagaggctgtggccctgagaaagatcacgtctacctgcagctgcaccacctacctccagagcagctggccatgcccttgcccggcatttcagagacagccatgatcttcgctggtgtggacgtcacgaaggagccgatccctgtcctccccaccgtgcattataacatggacggcattcccaccagctacgaggggcaggtcctgaggcacgggaatggccaggatcagattgtgcccggcctgtacgcctgtggggaggccgcctgtgcctctgcacatggtgtcaaccgcctcggggcaaactcgctattggacctggttgtctggtcaggcatgtgccctgagcatcgcagagtcgtgcaggcctggagataaagtccctccaattaaaccaaatgctggggaagaatctgtcacgaatcttgacaaattgagatttgctgatggaagaagcataagaacatcggaactgcgactcagcatgcagaaggtaagagcctggactcgctctggagtgagcaggctggctgcatacctggccctgcactggttttgtttttttaaaaacagatctagggggatgcaggtgcagctttgtgtggatgtactgggaggtggtggagtctgggcttttcatgtacctgtcacccaagtcgtgtgtgttgtactcagcaggtaattgctcatccccacccctcccgctttttggagcccacagtctg

SEQ ID NO: 32737 - DNA, 1840 bp, Homo sapiens
cgcagtctgcgcagggactggcgggactgcgcggcggcgactacagacgtgtcgggggtccggggcctgtcgcggttgccaagcgctcggcgcctggcgctggcgctggccaaggcgcctttactgttccaggatacagatctcctgattcaggtgtccagtgccttttgaactgaccgcaagccctcctggacgattggaactgtaatgtggaaagggctctgatggagccggttaaaatgcttcattatttgcaaaataccacatacagtaatacgatctggatgtctttcccctcctccactaagtagcataagtgaagacttcccagaggaagtgcgtctttttcatctcgtatctgagtcatggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggtagaaaattatggcatgccgtttagcagaactgaagatgggaagatttatcagcgtgcatttggcggacacagcctcaagtttggaaagggcgggcaggcccatgggtgctgctgtgtggctgatcggaccggccactcaatattgcacaccttatacgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggctactggcgcaactacttgagctgcacgtctgcccacaccagcaccagcgacggcacggccatgatcaccagggcaggccttccttgccaggacctcgagtttgttcagttccaccccacaggcacatatggtgctggttgtctcattacggaaggatgtcgtggagagggaggcattctcattaacagtcaaggcgaaaggtttatggagcgatacgcccccatcgcgaaggacctggcgtctagagatgtggtgtctcggtggatgactctggagatccgcgaaggaagaggctgtggccctgagaaagatcacgtctacctgcagctgcaccacctacctccagagcagctggccatgcccttgcccggcatttcagagacagccatgatcttcgctggtgtggacgtcacgaaggagccgatccctgtcctccccaccgtgcattataacatggacggcattcccaccagctacgaggggcaggtcctgaggcacgggaatggccaggatcagattgtgcccggcctgtacgcctgtggggaggccgcctgtgcctctgcacatggtgtcaaccgcctcggggcaaactcgctattggacctggttgtctggtcaggcatgtgccctgagcatcgcagagtcgtgcaggcctggagataaagtccctccaattaaaccaaatgctggggaagaatctgtcacgaatcttgacaaattgagatttgctgatggaagaagcataagaacatcggaactgcgactcagcatgcagaagtcaacgcaaaatcatgctgccgtgttccgtgtgggaagcttgttgcaagaaggttgtgggaaaatcagcaagctctatggagacctgaagcatctgaagacgtttgaccggggtgagcagacagtgggctc

SEQ ID NO: 32738 - DNA, 2268 bp, Homo sapiens
cagcagaatggaaaacgtatcccctaaatggctggccaaccttagcatatgggacagtgtgacctctctcacacagagccactaaaaactaaacactaaaaccagttttcttgagtaaaggtttctaagatggaaaatttaagcagcgagatatgtcaagttgtagacgttggccaggaaaaagccagcagcaaccaggcaggggagagtgtgcatccgacatcctcctgtgtgatgaagggatgacacctcttccctctgggctgtcagcctttactgttgcaggatacagatctcctgattcaggtgtccagtgccttttgaactgaccgcaagccctcctggacgattggaactgtaatgtggaaagggctctgatggagccggttaaaatgcttcattatttgcaaaataccacatacagtaatacgatctggatgtctttcccctcctccactaagtagcataagtgaagacttcccagaggaagtgcgtctttttcatctcgtatctgagtcaatgatatcctttttggatacaagcgtcatcctggttttctagagtgccaagccagggtggaaaggaggacctgggggctcagtccttccttgccccttgggctgcccttcagggttaagtagagggtcccagctgagctctctggattgcacaggagcacctgggtacataagaaggtgaacagtttgcaaggggaagtttgaattactatcccccacagcatttgttccttcaggacactaaccctctggatctgtgtcttctgtgtctccagtggcccaacggtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggtagaaaattatggcatgccgtttagcagaactgaagatgggaagatttatcagcgtgcatttggcggacacagcctcaagtttggaaagggcgggcaggcccatgggtgctgctgtgtggctgatcggaccggccactcaatattgcacaccttatacgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggctactggcgcaactacttgagctgcacgtctgcccacaccagcaccagcgacggcacggccatgatcaccagggcaggccttccttgccaggacctcgagtttgttcagttccaccccacaggcacatatggtgctggttgtctcattacggaaggatgtcgtggagagggaggcattctcattaacagtcaaggcgaaaggtttatggagcgatacgcccccatcgcgaaggacctggcgtctagagatgtggtgtctcggtggatgactctggagatccgcgaaggaagaggctgtggccctgagaaagatcacgtctacctgcagctgcaccacctacctccagagcagctggccatgcccttgcccggcatttcagagacagccatgatcttcgctggtgtggacgtcacgaaggagccgatccctgtcctccccaccgtgcattataacatggacggcattcccaccagctacgaggggcaggtcctgaggcacgggaatggccaggatcagattgtgcccggcctgtacgcctgtggggaggccgcctgtgcctctgcacatggtgtcaaccgcctcggggcaaactcgctattggacctggttgtctggtcaggcatgtgccctgagcatcgcagagtcgtgcaggcctggagataaagtccctccaattaaaccaaatgctggggaagaatctgtcacgaatcttgacaaattgagatttgctgatggaagaagcataagaacatcggaactgcgactcagcatgcagaagtcaacgcaaaatcatgctgccgtgttccgtgtgggaagcttgttgcaagaaggttgtgggaaaatcagcaagctctatggagacctgaagcatctgaagacgtttgaccggggtgagcagacagtgggctc

SEQ ID NO: 32739 - DNA, 1376 bp, Homo sapiens
cgcagtctgcgcagggactggcgggactgcgcggcggcgactacagacgtgtcgggggtccggggcctgtcgcggttgccaagcgctcggcgcctggcgctggcgctggccaaggcgtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgaggtagaaaattatggcatgccgtttagcagaactgaagatgggaagatttatcagcgtgcatttggcggacacagcctcaagtttggaaagggcaggcaggcccatcggtgctgctgtgtggctgatcggaccggccactcaatattgcacacctcatatgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggtaggaatctaatttctactttatttcctttgtaaaaatgaataaatttcatttagagtctctttattttaaggaaaatagaggcattgtagaatagcagttcagacacaggccttgatataaccacgtgagggtgatggcctttcccagccatggttcctcacctgtaaagggtgaggacagcagcacctgcctcgggggtgagaaagcatggccctcattagtcggtagtggctgccgtcaggttcacagcgtacctctcccgattttagatgaggaaactgtggcccgaagagtcacatggggttttctggcaaaatccctcttgttttagtgggttctatgtttatactgattcctgggatagataagtctgtcttctccacataatgaaaataaaaaactttaattttatacagtggcagttactttagccactttaaaagttaagaagtgtcagtacagccaagaaaaaaaatcagcaaaactacagggtgggaaaaaatattttccaaaccatatatctaatgatatcttagtatctaaaatagc

SEQ ID NO: 32740 - DNA, 1478 bp, Homo sapiens
cgcagtctgcgcagggactggcgggactgcgcggcggcgactacagacgtgtcgggggtccggggcctgtcgcggttgccaagcgctcggcgcctggcgctggcgctggccaaggcgtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgcggtgatgggcgggaggctctgggtgctctggtggtctgtttctagtacaagagtcctggaaaaaatgtaagcagttgaggcagatgtggcagccgaaagaatggtagaaaattatggcatgccgtttagcagaactgaagatgggaagatttatcagcgtgcatttggcggacacagcctcaagtttggaaagggcgggcaggcccatgggtgctgctgtgtggctgatcggaccggccactcaatattgcacaccttatacgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggtaggaatctaatttctactttatttcctttgtaaaaatgaataaatttcatttagagtctctttattttaaggaaaatagaggcattgtagaatagcagttcagacacaggccttgatataaccacgtgagggtgatggcctttcccagccatggttcctcacctgtaaagggtgaggacagcagcacctgcctcgggggtgagaaagcatggccctcattagtcggtagtggctgccgtcaggttcacagcgtacctctcccgattttagatgaggaaactgtggcccgaagagtcacatggggttttctggcaaaatccctcttgttttagtgggttctatgtttatactgattcctgggatagataagtctgtcttctccacataatgaaaataaaaaactttaattttatacagtggcagttactttagccactttaaaagttaagaagtgtcagtacagccaagaaaaaaaatcagcaaaactacagggtgggaaaaaatattttccaaaccatatatctaatgatatcttagtatctaaaatagc

SEQ ID NO: 32741 - DNA, 1146 bp, Homo sapiens
cgcagtctgcgcagggactggcgggactgcgcggcggcgactacagacgtgtcgggggtccggggcctgtcgcggttgccaagcgctcggcgcctggcgctggcgctggccaaggcgatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggtagaaaattatggcatgccgtttagcagaactgaagatgggaagatttatcagcgtgcatttggcggacacagcctcaagtttggaaagggcaggcaggcccatcggtgctgctgtgtggctgatcggaccggccactcaatattgcacacctcatatgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggtaggaatctaatttctactttatttcctttgtaaaaatgaataaatttcatttagagtctctttattttaaggaaaatagaggcattgtagaatagcagttcagacacaggccttgatataaccacgtgagggtgatggcctttcccagccatggttcctcacctgtaaagggtgaggacagcagcacctgcctcgggggtgagaaagcatggccctcattagtcggtagtggctgccgtcaggttcacagcgtacctctcccgattttagatgaggaaactgtggcccgaagagtcacatggggttttctggcaaaatccctcttgttttagtgggttctatgtttatactgattcctgggatagataagtctgtcttctccacataatgaaaataaaaaactttaattttatacagtggcagttactttagccactttaaaagttaagaagtgtcagtacagccaagaaaaaaaatcagcaaaactacagggtgggaaaaaatattttccaaaccatatatctaatgatatcttagtatctaaaatagc

SEQ ID NO: 32742 - DNA, 765 bp, Homo sapiens
atatcaccttaaaaccttaaaggttggcttaacacttcttgccctttttttttctttcttttagtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggtaggaatctaatttctactttatttcctttgtaaaaatgaataaatttcatttagagtctctttattttaaggaaaatagaggcattgtagaatagcagttcagacacaggccttgatataaccacgtgagggtgatggcctttcccagccatggttcctcacctgtaaagggtgaggacagcagcacctgcctcgggggtgagaaagcatggccctcattagtcggtagtggctgccgtcaggttcacagcgtacctctcccgattttagatgaggaaactgtggcccgaagagtcacatggggttttctggcaaaatccctcttgttttagtgggttctatgtttatactgattcctgggatagataagtctgtcttctccacataatgaaaataaaaaactttaattttatacagtggcagttactttagccactttaaaagttaagaagtgtcagtacagccaagaaaaaaaatcagcaaaactacagggtgggaaaaaatattttccaaaccatatatctaatgatatcttagtatctaaaatagc

SEQ ID NO: 32743 - DNA, 983 bp, Homo sapiens
cgcagtctgcgcagggactggcgggactgcgcggcggcgactacagacgtgtcgggggtccggggcctgtcgcggttgccaagcgctcggcgcctggcgctggcgctggccaaggcggtagaaaattatggcatgccgtttagcagaactgaagatgggaagatttatcagcgtgcatttggcggacacagcctcaagtttggaaagggcgggcaggcccatgggtgctgctgtgtggctgatcggaccggccactcaatattgcacaccttatacgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggtaggaatctaatttctactttatttcctttgtaaaaatgaataaatttcatttagagtctctttattttaaggaaaatagaggcattgtagaatagcagttcagacacaggccttgatataaccacgtgagggtgatggcctttcccagccatggttcctcacctgtaaagggtgaggacagcagcacctgcctcgggggtgagaaagcatggccctcattagtcggtagtggctgccgtcaggttcacagcgtacctctcccgattttagatgaggaaactgtggcccgaagagtcacatggggttttctggcaaaatccctcttgttttagtgggttctatgtttatactgattcctgggatagataagtctgtcttctccacataatgaaaataaaaaactttaattttatacagtggcagttactttagccactttaaaagttaagaagtgtcagtacagccaagaaaaaaaatcagcaaaactacagggtgggaaaaaatattttccaaaccatatatctaatgatatcttagtatctaaaatagc

SEQ ID NO: 32744 - DNA, 290 bp, Homo sapiens
tgctgggattacaagcgtgagccactgcatgcccgacctacttccctctctttctctgacctgcagcacagacaccctgttgagggaggtgggcttgtggaggaatgggcatcttgacatttcacctgaaatcttcctttccacaggtcctgaggcacgggaatggccaggatcagattgtgcccggcctgtacgcctgtggggaggccgcctgtgcctctgcacatggtgtcaaccgcctcggggcaaactcgctattggacctggttgtctggtcaggcatgtgccct

SEQ ID NO: 32745 - DNA, 674 bp, Homo sapiens
gaaaacgttgacaaacacctgtgtcagggcctctgctgttgggtctggggccacagggttgggtaagagccaatatatgagctcagatcatagctctattgagctggttgttacaggaggtggtcaagactttgcttgggatctgcccagcccacctttctggctttgtctcctgctcctgcccctctggactgctggcctgtccccaagtgaacacacttgctctttcacacacagacccatggagaccactccctatcatactcactggcacttctacccagaattcacctgagccaccctctttcctttgggctttcaaggcccagctaaagtattagctcctctgtgaaggctgccctctcggagtttgttgctgcctccttgtccaaaaggacctaagataataggttttaataatgtgtacagttatttatttccatctctaagatcccattagaccaggggccctcggagtcagtgagcttgtctttgtgtttttgctgggacctaatacacaatgggtcactcaggaattgcaattaaaatgggtccagagaaatgtgacctgcaagaataaagggatagggcaacccactctggtccccttccacgctgtggaagctttgttctttcgctcttcacaataaatcttgctgctgctcactcttaaa

SEQ ID NO: 32746 - DNA, 528 bp, Homo sapiens
tcacctgaggtcaggagttcgagaccagtctggccaacatggcaaaaccccatctctactaaaaatacaaaaaaattagctgggtgtgatggagggcacctgtaatcccagctactcgggaggctgaggcagaatttcttgaacccaggaggcggaggttgcagtgagccaagatcacgccactgcatagaccaggataatcagtgaaacaagagggcagaggcaagagccctgtcaataccaactctttcctcttttaccctccttgataccttgttttatgaagggatttaggtcttactgttcctcctatactgtcacctccttaataaggctttatgatgtgtcttttttcccttcattccacagtagagtaggtaccagtaaacatccccttactggccaggtgcgctggctcacgcctataaatcccaacactttggaaggccgaggtgggcagatcacttgagcccaggtgttcaagattaagtctgggcaatatggcgaaaccccatctccactaaaaca

SEQ ID NO: 32747 - DNA, 2349 bp, Homo sapiens
gcaggctgctgtctcacagagcgagaaggtgtcaggagcagcccagttgtgtctctctctctacctctgtgaagggcgcgaatgggcagagcagaacttctagaagggaagatgagcacccaggatccctcagatctgtggagcagatccgatggagaggctgagctgctccaggacttggggtggtatcacggcaacctcacacgccatgctgctgaagctcttctcctctcaaatggatgtgacggcagctaccttctgagggacagcaatgagaccaccgggctgtactctctctctgtgagggccaaagattctgttaaacactttcatgttgaatatactggatattcatttaaatttggctttaatgaattctcatctttgaaggattttgtcaagcattttgcaaatcagcctttgattggaagcgagacaggcactctgatggttctaaaacatccctacccaagaaaagtggaagaaccctccatttatgaatctgtccgggttcacacagcaatgcagacaggaagaacagaagatgaccttgtgcccacagcaccttctctgggcaccaaagaaggttacctcaccaaacagggaggcctggtcaagacctggaaaacaagatggtttactctgcacaggaatgaactgaaatacttcaaagaccagatgtcaccagaaccaattcggatcctagacctaacagaatgttcagctgtacaattcgattattcacaagaaagggtaaactgtttttgtttggtatttccattcaggacattttatctctgtgcaaagaccggagtagaagctgatgagtggatcaagatattacgctggaaattgtcacaaataagaaaacagctcaaccaaggggaaggcacgatccgatctcggtcgttcatctttaaatagatctttcttgccaaggaatgctctggcccaggagcaaggtggaatgtttccctgacgctgtgatctgcagcaggcttcaaatgaaaaccgactaaggattttctttcaaaaacaaatcagaagcagatgctgattgggacccatataccacgttgctgactcacgttgctgcccttccatgatgttgccatctccttgagaacactgaagcaatcaccattctgatagaaagtgcttaaaccaccactcttaggtctgctcactcttagaacacacaatggaagaggaagggtttttgttttcactcattgtggtccccaagcctattgacactagttgcctagagtcccactgtgagtcatggtcagcctgtctgacatccaggttgtgctattaaccaagaaggaaacagatacttggaggcttagatgacttctgcaggatttatattcagatagaaaacatcaaatattttcaggggagaggtttttttttttaatttttccccctttatacaaaaaaaaaagaacatttccaaaactaaaatagaaaatgcttgtggcatttattttctctttttaaaaggttcagaaatttggcaggtcctttgcttctaatgacaaaactgtgagagctagatgtcctatgggcaattaggtagtataataaaggtaaatgaaggtacaatttttaaaccattattttcaccctgttggggtaaatgttttaaagagtgagaaaacataaattgagaaagggtgataaagtaatagataacttttagtttaataataattattgttattatactactaataatagagcacttgtaagcactaagttatctttatccaacatttctccaaatggactgaaagaaacttttcaaggacagtgtattataacaatccctttcccagaattagttgtatagggttggcccaagagatgtaagaaaaatctcgcattgctccctaagcaccctgggccttattaaagagcaacttctatttccagtcgggggagtaacactaaagctacaagaaatatgtaataatgataggtaataatgtgttccaaagctttttcaaactagaataaggaggcaaatagaagaatgagatactgatgtccacagttcattggcagaatctaaccccttctgttatcttttttaatactatttttgtttagatagaagtttcaaagaagataaaaatgcttgaagagcctgagagtaaaaagattatgctgcaaagctatgatataaactgctcttgcagtccaaagggatacctgattaaagaagtttcttatttaaacatctcagacgcaaaaattacattaaatttttgtatatttcaacaacattttaaatgtattttgttatgtttgtattatataggataaagcaaatgtcaagtt

SEQ ID NO: 32748 - DNA, 2979 bp, Homo sapiens
gcaggctgctgtctcacagagcgagaaggtgtcaggagcagcccagttgtgtctctctctctacctctgtgaagggcgcgaatgggcagagcagaacttctagaagggaagatgagcacccaggatccctcagatctgtggagcagatccgatggagaggctgagctgctccaggacttggggtggtatcacggcaacctcacacgccatgctgctgaagctcttctcctctcaaatggatgtgacggcagctaccttctgagggacagcaatgagaccaccgggctgtactctctctctgtgagggccaaagattctgttaaacactttcatgttgaatatactggatattcatttaaatttggctttaatgaattctcatctttgaaggattttgtcaagcattttgcaaatcagcctttgattggaagcgagacaggcactctgatggttctaaaacatccctacccaagaaaagtggaagaaccctccatttatgaatctgtccgggttcacacagcaatgcagacaggaagaacagaagatgaccttgtgcccacagcaccttctctgggcaccaaagaaggttacctcaccaaacagggaggcctggtcaagacctggaaaacaagatggtttactctgcacaggaatgaactgaaatacttcaaagaccagatgtcaccagaaccaattcggatcctagacctaacagaatgttcagctgtacaattcgattattcacaagaaagggtaaactgtttttgtttggtatttccattcaggacattttatctctgtgcaaagaccggagtagaagctgatgagtggatcaagatattacgctggaaattggtcaaggacaaaagctgtattttgtctgctctctgtatatctcccgaggagaagactgatcacaaataagaaaacagctcaaccaaggggaaggcacgatccgatctcggtcgttcatctttaaatagatctttcttgccaaggaatgctctggcccaggagcaaggtggaatgtttccctgacgctgtgatctgcagcaggcttcaaatgaaaaccgactaaggattttctttcaaaaacaaatcagaagcagatgctgattgggacccatataccacgttgctgactcacgttgctgcccttccatgatgttgccatctccttgagaacactgaagcaatcaccattctgatagaaagtgcttaaaccaccactcttaggtctgctcactcttagaacacacaatggaagaggaagggtttttgttttcactcattgtggtccccaagcctattgacactagttgcctagagtcccactgtgagtcatggtcagcctgtctgacatccaggttgtgctattaaccaagaaggaaacagatacttggaggcttagatgacttctgcaggatttatattcagatagaaaacatcaaatattttcaggggagaggtttttttttttaatttttccccctttatacaaaaaaaaaagaacatttccaaaactaaaatagaaaatgcttgtggcatttattttctctttttaaaaggttcagaaatttggcaggtcctttgcttctaatgacaaaactgtgagagctagatgtcctatgggcaattaggtagtataataaaggtaaatgaaggtacaatttttaaaccattattttcaccctgttggggtaaatgttttaaagagtgagaaaacataaattgagaaagggtgataaagtaatagataacttttagtttaataataattattgttattatactactaataatagagcacttgtaagcactaagttatctttatccaacatttctccaaatggactgaaagaaacttttcaaggacagtgtattataacaatccctttcccagaattagttgtatagggttggcccaagagatgtaagaaaaatctcgcattgctccctaagcaccctgggccttattaaagagcaacttctatttccagtcgggggagtaacactaaagctacaagaaatatgtaataatgataggtaataatgtgttccaaagctttttcaaactagaataaggaggcaaatagaagaatgagatactgatgtccacagttcattggcagaatctaaccccttctgttatcttttttaatactatttttgtttagatagaagtttcaaagaagataaaaatgcttgaagagcctgagagtaaaaagattatgctgcaaagctatgatataaactgctcttgcagtccaaagggatacctgattaaagaagtttcttatttaaacatctcagacgcaaaaattacattaaatttttgtatatttcaacaacattttaaatgtattttgttatgtttgtattatataggataaagcaaatgtcaagttaaaatgtattgtgttgtttgtaaagtaagaagttactggccaggagcggcggctcatgcctgtaatcccaggactttggtaggccaagacaagcagatcacttgaggtcaggagttcaacatcagcctggccaacatgatgaaaccttgtctttactaaaaatacaaaaattagctgggcatggtggcaggcgcctgtaatcccagctactcaggaggctgaggcaggagaattgcttgaacccgggaggtggaggttgcagtgaaccaagatcgcggcgctgcactctagcctgggtgacagagtcagactccgtcccaaaaaaacaaacaaacaaaacaaaacaaaaaaaaacagaagttacaaatgaatactcacggatatgtatagttttatgtttgttttcttagaaacaaatgtgtttctttgggtgggtaatattgtgttttactatgtttaccttttataaaacataacctgtttatttatattctttggctttgtttattaaaaagcatgattttgctgtgcatgtaccattttgctattaaaatttatttttaatatttgt

SEQ ID NO: 32749 - DNA, 2695 bp, Homo sapiens
gcaggctgctgtctcacagagcgagaaggtgtcaggagcagcccagttgtgtctctctctctacctctgtgaagggcgcgaatgggcagagcagaacttctagaagggaagatgagcacccaggatccctcagatctgtggagggccaaagattctgttaaacactttcatgttgaatatactggatattcatttaaatttggctttaatgaattctcatctttgaaggattttgtcaagcattttgcaaatcagcctttgattggaagcgagacaggcactctgatggttctaaaacatccctacccaagaaaagtggaagaaccctccatttatgaatctgtccgggttcacacagcaatgcagacaggaagaacagaagatgaccttgtgcccacagcaccttctctgggcaccaaagaaggttacctcaccaaacagggaggcctggtcaagtcaccagaaccaattcggatcctagacctaacagaatgttcagctgtacaattcgattattcacaagaaagggtaaactgtttttgtttggtatttccattcaggacattttatctctgtgcaaagaccggagtagaagctgatgagtggatcaagatattacgctggaaattgtcacaaataagaaaacagctcaaccaaggggaaggcacgatccgatctcggtcgttcatctttaaatagatctttcttgccaaggaatgctctggcccaggagcaaggtggaatgtttccctgacgctgtgatctgcagcaggcttcaaatgaaaaccgactaaggattttctttcaaaaacaaatcagaagcagatgctgattgggacccatataccacgttgctgactcacgttgctgcccttccatgatgttgccatctccttgagaacactgaagcaatcaccattctgatagaaagtgcttaaaccaccactcttaggtctgctcactcttagaacacacaatggaagaggaagggtttttgttttcactcattgtggtccccaagcctattgacactagttgcctagagtcccactgtgagtcatggtcagcctgtctgacatccaggttgtgctattaaccaagaaggaaacagatacttggaggcttagatgacttctgcaggatttatattcagatagaaaacatcaaatattttcaggggagaggtttttttttttaatttttccccctttatacaaaaaaaaaagaacatttccaaaactaaaatagaaaatgcttgtggcatttattttctctttttaaaaggttcagaaatttggcaggtcctttgcttctaatgacaaaactgtgagagctagatgtcctatgggcaattaggtagtataataaaggtaaatgaaggtacaatttttaaaccattattttcaccctgttggggtaaatgttttaaagagtgagaaaacataaattgagaaagggtgataaagtaatagataacttttagtttaataataattattgttattatactactaataatagagcacttgtaagcactaagttatctttatccaacatttctccaaatggactgaaagaaacttttcaaggacagtgtattataacaatccctttcccagaattagttgtatagggttggcccaagagatgtaagaaaaatctcgcattgctccctaagcaccctgggccttattaaagagcaacttctatttccagtcgggggagtaacactaaagctacaagaaatatgtaataatgataggtaataatgtgttccaaagctttttcaaactagaataaggaggcaaatagaagaatgagatactgatgtccacagttcattggcagaatctaaccccttctgttatcttttttaatactatttttgtttagatagaagtttcaaagaagataaaaatgcttgaagagcctgagagtaaaaagattatgctgcaaagctatgatataaactgctcttgcagtccaaagggatacctgattaaagaagtttcttatttaaacatctcagacgcaaaaattacattaaatttttgtatatttcaacaacattttaaatgtattttgttatgtttgtattatataggataaagcaaatgtcaagttaaaatgtattgtgttgtttgtaaagtaagaagttactggccaggagcggcggctcatgcctgtaatcccaggactttggtaggccaagacaagcagatcacttgaggtcaggagttcaacatcagcctggccaacatgatgaaaccttgtctttactaaaaatacaaaaattagctgggcatggtggcaggcgcctgtaatcccagctactcaggaggctgaggcaggagaattgcttgaacccgggaggtggaggttgcagtgaaccaagatcgcggcgctgcactctagcctgggtgacagagtcagactccgtcccaaaaaaacaaacaaacaaaacaaaacaaaaaaaaacagaagttacaaatgaatactcacggatatgtatagttttatgtttgttttcttagaaacaaatgtgtttctttgggtgggtaatattgtgttttactatgtttaccttttataaaacataacctgtttatttatattctttggctttgtttattaaaaagcatgattttgctgtgcatgtaccattttgctattaaaatttatttttaatatttgt

SEQ ID NO: 32750 - DNA, 396 bp, Homo sapiens
tattatatacatataatgcctcttcatttcccaactgattgactgatggcagggtctttccaaggcagtatgaataaagacaattatacccataggatgaacaatgtaatagccttgtctttccaatcccatggtagcagcattaagcaccccatctctatgctcagaacatttagaaatattgatattaaaattatcacactgggctgagtgcagtggctcacacctgtaatcccaacattttggaaaactgaggcaagaggatggcttgaggccaggagtttgagaccagcctgggcaacatagtgagatgctatctctacaaaaaaatgttttaaaaattagctgggcatggtggcatgtgcctgtagtcctagctgttcaggatgctggggc

SEQ ID NO: 32751 - DNA, 358 bp, Homo sapiens
aattacacttgatcctccaagatctccacctccctcaacatctagatccatcctttcacaaatatttcccttgtgtattcacagcacaagggctaaaaaggaaagcccccaagaattcaatccaacatttttatatatgaaacaagccacatttataatataaaagtaataacagaatgaatgaaaatatttacaaatgtgtatcggaaaaaggatttgctacatatataaagaatttcaaaatgaactcagtaagaaaacgaaccacccggccaggaacagtggctcacatctataatcccagcactttgggaggccaaggcgggtggaacacctgaggtcaggagttcaaggccag

SEQ ID NO: 32752 - DNA, 521 bp, Homo sapiens
  misc_feature (231)..(231): n is a, c, g, or t
  misc_feature (233)..(233): n is a, c, g, or t
  misc_feature (403)..(403): n is a, c, g, or t
  misc_feature (418)..(418): n is a, c, g, or t
  misc_feature (445)..(445): n is a, c, g, or t
  misc_feature (463)..(463): n is a, c, g, or t
ctcactctctttgttccagtaagagatggttgttaagaagagcctggcatctcccctctccctttcttaccatctgatttctacccacagcagttccctttccaccacagtagaagcagcctaaggccctcactgggtgcagacacccaatcttgaacttttccagacattcgaattgtgagacaaataaaccttttctctttgggccctaggttccctgcctgcctctgntnactgctagtgaaaagggttctggtgctgtggcctcacattttatggaggccatggtcattccagtttttctaccatcttgttctcccccttcaccaacgatggggggcattctcttcgcactgtgttttaaaaatggacattcttgttcttcttgtctgcctgagagtgnacagagggttttggncccctaccttccctcctactctgattntccaggctcttggtgcanttctttggggctgggtatcttaagtcttcagttctggcttccccggctggggaaattg

SEQ ID NO: 32753 - DNA, 378 bp, Homo sapiens
atgttggccaggctggtcgctggtcttgaactcctgacctcaagtgatctgcccacctcagcctccccaaaatgctagaattacaggcgtgagcaccgagccgggcctcaaagtgccctttcaacaggcattcccgggggccctcctcggaggggtggtgccagtgtgcttgtgaaatttaagcgtccagtgtgggttttgccagcctcatctcacgctgatgagacagaacagggcatctgactgctcttgggcacagctagggaaactgaggctgatggggggcaggaaacctgactgtcctcatgcacagctggggaaattgaggctgggggcaggacagctggccgcccttgtgtacagatgggaaacaggttg

SEQ ID NO: 32754 - DNA, 343 bp, Homo sapiens
ttttttttgagatgaggtcttgctatgtatgctgcctagggttggtcttgaactgggctccagcgatccacccgcctcagtctcccgaagtgctgggattaccagccaaaatacagaaattcaacattgatacaaactattatctaacccacaatccatattccaacatagtctattgtcccaataatgtcctctataggttttccctcccaccttttttcctgatctgggatctactggaggaaatcctacttagttgtcctgtctcttgattcccctataatccagaactgtttctcagccttactttgccttttattatcttgatatttttgtacagact

SEQ ID NO: 32755 - DNA, 793 bp, Homo sapiens
tggtaggtgcgctttgcttcctaacccgttgccgggttggagattccacctccgaagttttctttctgacttttgattttacattcctagtacagtggagaagcccaggcggcctagaatccagtgtcgtccgtgagtgcttggctggtgttcaagtgcatcttccagcctgagaccgcgtggactcgctcatcgtgagggcgagaggaggataagcccattgggctgtcggctgagagtgaggtgcgggtttcttcagcagattgctgatgaaatccttggcatcgtcggagatctcatcgaatgcctcgtcgtcgaagtcccaggtggctgaggtaacgttggccaaggtttcgttatcgttgtctcccatgaagggggaaaggccactgactctggagagacaagagcaggacagcaggtgtggctaggagagggcgcgacgaccagatgagggaattgaggcacagcccaggctcaagtcacctgcccaaagattcacagccagtgagattggaagccaggtatctgcctctagagcctgtcctcttaaatgctatactatcctaacatttctgtaaagatgaagtaaattgcagtgttcagcactggcaccaggcctggtccacagtaaggaggcggtccatgcccggagatctcatgcagttctgctgggttccctccactgccttaccaagctgtgagtgcaggaatgactttgtgaccagcagcttaagccaaataaactttataaggtaaagaatttcaaaacaaaatagagcagatttgtggc

SEQ ID NO: 32756 - DNA, 464 bp, Homo sapiens
cagacattcattgaggtttttctatgtgccaggcactgggtcaagtgcctaaaacaagtgaactcacttaatcttaacactgccctatgatgcaagtaattcttataactttgttttacagatgagggaattgaggcacagcccaggctcaagtcacctgcccaaagattcacagccagtgagattggaagccaggtatctgcctctagagcctgtcctcttaaatgctatactatcctaacatttctgtaaagatgaagtaaattgcagtgttcagcactggcaccaggcctggtccacagtaaggaggcggtccatgcccggagatctcatgcagttctgctgggttccctccactgccttaccaagctgtgagtgcaggaatgactttgtgaccagcagcttaagccaaataaactttataaggtaaagaatttcaaaacaaaatagagcagatttgtggc

SEQ ID NO: 32757 - DNA, 705 bp, Homo sapiens
ggacagtcttccaatggctctcacagcattgcccgttttctgccatttccttcttgccatgtacttcttcatccggtccttggagagtttcttggcctccatgttcttggtatctttcattagccatggatgctgaagacctgcgtgcagtccaggcggttttttcttcagcagattgctgatgaaatccttggcatcgtcggagatctcatcgaatgcctcgtcgtcgaagtcccaggtggctgaggtaacgttggccaaggtttcgttatcgttgtctcccatgaagggggaaaggccactgactctggagagacaagagcaggacagcaggtgtggctaggagagggcgcgacgaccagatgagggaattgaggcacagcccaggctcaagtcacctgcccaaagattcacagccagtgagattggaagccaggtatctgcctctagagcctgtcctcttaaatgctatactatcctaacatttctgtaaagatgaagtaaattgcagtgttcagcactggcaccaggcctggtccacagtaaggaggcggtccatgcccggagatctcatgcagttctgctgggttccctccactgccttaccaagctgtgagtgcaggaatgactttgtgaccagcagcttaagccaaataaactttataaggtaaagaatttcaaaacaaaatagagcagatttgtggc

SEQ ID NO: 32758 - DNA, 1066 bp, Homo sapiens
ggacagtcttccaatggctctcacagcattgcccgttttctgccatttccttcttgccatgtacttcttcatccggtccttggagagtttcttggcctccatgttcttggtatctttcattagccatggatgctgaagacctgcgtgcagtccaggcggttttttcttcagcagattgctgatgaaatccttggcatcgtcggagatctcatcgaatgcctcgtcgtcgaagtcccaggtggctgaggtaacgttggccaaggtttcgttatcgttgtctcccatgaagggggaaaggccactgactctggagagacaagagcaggacagcaggtgtggctaggagagggcgcgacgaccagatgagggaattgaggcacagcccaggctcaagtcacctgcccaaagattcacagccagtgagattggaagccaggtatctgcctctagagcctgtcctcttaaatgctatactatcctaacatttctgtaaagatgaagtaaattgcagtgttcagcactggcaccaggcctggtccacagtaaggaggcggtccatgcccggagatctcatgcagttctgctgggttccctccactgccttaccaagctgtgagtgcaggaatgactttgtgaccagcagcttaagccaaataaactttttttttttttttagtaaatatatgttttatttgtcaagagtaaatgtcagttttatttagaatattcaagtacaaaaaatgaaaatgtatatatctatgactgttaagaaatgttagaaatcattaaaatgttctgagaataccagtaaggcactgaatgcaaataccacctgaaatatgaattatgtgcatttttatatctttaatattcagatgttcatagttattttcttaaaaagtatttttaataaaatgattcaaccttattatttttaccctggaagacagagtttaaacaagtatgtaatgaaaagttttcctaatgaaagctgtgatacactcatgctcaaaggtactttatccttaggaaaaaatagcttatatatctggatgttttaactttt

SEQ ID NO: 32759 - DNA, 741 bp, Homo sapiens
ggcggaaagatgaaaattatcactcacccccccctcaatgagggaattgaggcacagcccaggctcaagtcacctgcccaaagattcacagccagtgagattggaagccaggtatctgcctctagagcctgtcctcttaaatgctatactatcctaacatttctgtaaagatgaagtaaattgcagtgttcagcactggcaccaggcctggtccacagtaaggaggcggtccatgcccggagatctcatgcagttctgctgggttccctccactgccttaccaagctgtgagtgcaggaatgactttgtgaccagcagcttaagccaaataaactttttttttttttttagtaaatatatgttttatttgtcaagagtaaatgtcagttttatttagaatattcaagtacaaaaaatgaaaatgtatatatctatgactgttaagaaatgttagaaatcattaaaatgttctgagaataccagtaaggcactgaatgcaaataccacctgaaatatgaattatgtgcatttttatatctttaatattcagatgttcatagttattttcttaaaaagtatttttaataaaatgattcaaccttattatttttaccctggaagacagagtttaaacaagtatgtaatgaaaagttttcctaatgaaagctgtgatacactcatgctcaaaggtactttatccttaggaaaaaatagcttatatatctggatgttttaactttt

SEQ ID NO: 32760 - DNA, 474 bp, Homo sapiens
ttaagacagactctagtcaagcccacttaccaccaggtgggtgtttaggacagggtaggtcttccactatatctgttttcctcttagttcgccaggcccgcctgctctgggccacgcaggacacggacgtcagcttctcctggagcgctcgctcactttattccatctctacgagctcctcaagtatcccagagcatccccaggcctgtggccacctcgggtctggatgccgcattctctgacctgtggcacattctgggtgcccatgattatgatgaggttctgtgcccatgtggcctcagggctcttgagaccacccttcaaccaggtctttgctcacctgtctcctgcccagggacgccacccaggtcaccggtgcaaacctccagcccctgcccgtttctctccatgagtgcattgccacctcgcagcctcttccacttgctcattcctggtgttattgcctgtctccca

SEQ ID NO: 32761 - DNA, 860 bp, Homo sapiens
cccttttcctgtctctagaggtcagggtgttggggcggaaagttcaaacactttaatattacggttggttcctctggcacccaggccccatcccaaggctctccaggagaccccagccaccagtcattcattagcatgccaaaagacacttaacactttggagagtataagagttttaggagctgcattccagtaaacaggtgtgcagatcagataagcatttcttattgtattgcagtatcagagatgatgctcaccgctggaccacattccaagatatggctccacttattgatctttgaatgaaggggtaccttattgatcctccccctgaccttaccccaaataacaaatcataccagtactaaactggcagaactcaagattggttaggaaagatcctctgaaacttcgtataatgacagttaccttgttttgagtgtgtcccctgtgccaggcactgtgctgagagctttgtgtgttcagactcacttcacagttacaaaaccctctttaatatgtgggaactgggcttgaaatggtttaggtacacggtccagttcatagccaatgttgtgttactagaaagggatcccaatacagaccctgagagtgggttcttggaccttgtgcaaggaagaattcagggcaaggccatagagtaaggtgaaagcaatttgttagagaagttaaaaaaagaaaaaagaatggctactccataggcagagcagcagcatgggctgcttaactgaatatacttatagttatttcttgattatatactaaacaagcagtggattgttcatgagttttccaggaaaggtgtgggcagttcctgaaactgagggttcctccccctt

SEQ ID NO: 32762 - DNA, 565 bp, Homo sapiens
gtttctccccatgtggtaatctgaaatatggcctcgtgggaagggaaagacctgaccgttccccagcccgacacccgtaaagggtctgtgctgaggaggattagtaaaagaggaaggcctctttgcagttgagataagaggaaggcatctgtctcctgctcgtccctgggcaatagaatgtctgggtgtaaaacccgattgtatattccatctactggagataggagaaaaccgccttagggctggaggtgagacatgctggcggcaataggcaatagtgctctttaaagcattgagatgtttatgtatgtgcacattaaaagcacagcacctttttctttaccttgtttatgatgtagagatgtttgttcacgttttcctgctgaccctctccccactattaccctgttgtcctgccactctccattgtctccctgttgtccccctctccgatatggtagagatactaatgaataaatactgagggaactcagagaccggtgccggcgtgggtcctccatatgctgaacgccggttccctgggcccacttttctttctctatta

SEQ ID NO: 32763 - DNA, 360 bp, Homo sapiens
gttccagcccaatgtactagaaagagcacagagttctagaagcttcaactctgccattaactcctgcctgagagaagaggaccaacaatcctatttgccatatggaaagttacatatagtgtgtaggacacattttttttttttcaaatggatttttgagccagttctgaatacaagcagcagttaacagttcagctgcttcaataatggtttggggttgggccctgtgtgccttgggcaccttgagcaagttttccccctctctgtgcctctgtttcctcatctgaaaaacagaagtaataatattacctacttcataggatcatcataaggattaaacaaactggttcatgtgaaaac

SEQ ID NO: 32764 - DNA, 466 bp, Homo sapiens
acttaataactcttaacttctgtaattatcagtatcatccagaaaaaaccctccagtgttattcggacacacactgagaacatgctgggtcccaggcaccatgagttcggggattctgcaatgaataagacccataaaaatcctgggttcatggaaccagcacttcagtggggatacaattttctgctttcagggttggcatataaaactgcaatgagccgggcacagtggctcacacctgtaatcccatcactttggtagactggggtgggaagattgcttgaggccaggagtgtgagaccagcctggtaatgtggtcagaccctatctgtacaaacatttaaaaaattatctgggtgtggtagtcccagctacaggggctgaggcagaagaatcacttgagcccggcagctcatcatggctgcggtgagctatgatcgcaacactgccctccagcctgagtgaa

SEQ ID NO: 32765 - DNA, 343 bp, Homo sapiens
aaggggaattgggaatgacaattcacagacacagggtctctttctaggatgatgaaaaagttctagaatcagataaaagtgatggctgcacaacactgtgaatatactaaaaaccactgaattgtgcacttcaaagtggtgaactttgttacctgaattttatcttaataaaaaattgcaaattaaaattaaataaaaagaagagtgagtgcaccacctccctacacacaccagcatgcccctccttctaactttccttttaccttccaaagtaataaactctccatcggtagaattattcaagcagaagctgaaacatcatctgtcaggagtatgctactga

SEQ ID NO: 32766 - DNA, 219 bp, Homo sapiens
ttcatattcctggagaattaagagcattttcaaaatgttttacataagtgttgcttacctctaagtcctcactgcaaaggtaaatactactgcaaaggagagaaaagaaaagaagtgaatgtttagaaaaaaacaaaaaagaaagtagagcaagaaaggcaggaaaaggaagtaatgaaggagaggatagaacaaaaagaaggcccaactgatggggga

SEQ ID NO: 32767 - DNA, 359 bp, Homo sapiens
ggagaatgggatgaacctgggaggcggagcttgcagtgagcccagatcgcaccactgcactccagcctgggtgacagagtgagattccatctcaaaaaataaataaataaataaaaattggaatttgttcaaatgcaaataaaggatagataaatcatctaagttttatcaaaccacacatcttatcaaacaaaataaataccaaagacgtgagcaggctaaataccttttcaattaattctattttttaataaaatgaaacattttaaatgtcacgtgggccacttgtggtggctcagacctgtaatctcagcactttgggaggcaaggcaggctggtgaaaccccatctccacaaca

SEQ ID NO: 32768 - DNA, 388 bp, Homo sapiens
ttttttttttttgagacatagtctcactctgtcacccaggctggagtgcagtgacgcgatctcggcacactgcaagctccgcctcccaggttcactccattctcctgcctcagcctcccgagtaactgggactacaggcgcccgccaccacgcctggctaattttttgtatttttagtagagacggggtttcactgttagccaggatggtctctatctcctgacctcatgatttacccgcctcggcctcccaaagtgctgggattaccggcgtgagccaccgcgtctggctgaaaatccttttctttccgatgattttgatagtctagcgacggacatttgaatcggaagatattttcatatttgtccaagatctcagccaaatgcat

SEQ ID NO: 32769 - DNA, 877 bp, Homo sapiens
tcctacacccctgccagcggcaccatggcttccctctggctcctctcctgcttctcccttgtgggggccgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggtgactctggaggccccctggtctgccagaaggacggagcctggaccctggtgggcattgtgtcctggggcagccgcacctgctctaccaccacgcccgctgtgtacgcccgtgtcaccaagctcataccctgggtgcagaagatcctggccgccaactgagcccgcagctcctgccacccctgccttaagatttcccattaaatgcatctgtttagaaaaa

SEQ ID NO: 32770 - DNA, 524 bp, Homo sapiens
  misc_feature (27)..(27): n is a, c, g, or t
  misc_feature (96)..(96): n is a, c, g, or t
  misc_feature (118)..(118): n is a, c, g, or t
  misc_feature (120)..(120): n is a, c, g, or t
ttggggccaaaaaaaaaccttggcccnggtttttttttcccaaggaacaagtgttccggccggttgttgccttggccccaaggcgccgggaagganggaattttcccggcgggggaanantgtgtgccaacccaacagggtgggggcaaggaccaaagtaacaaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggtgactctggaggccccctggtctgccagaaggacggagcctggaccctggtgggcattgtgtcctggggcagccgcacctgctctaccaccacgcccgctgtgtacgcccgtgtcaccaagctcataccctgggtgcagaagatcctggccgccaactgagcccgcagctcctgccacccctgccttaagatttcccattaaatgcatctgtttagaaaaa

SEQ ID NO: 32771 - DNA, 806 bp, Homo sapiens
ccacgcgtgcgagcggcatggcttcctctggctctctctgcttctcccttgtgggggcgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggactccgacgtggtcgtggctggggaagtgattaaataaaagcaacgcaagaaaaaaaaaaaaaacaaaaaaaaaaaaaaaaaaaaaataaaaaataataaaaaaaaaaacaaaaaaaaaaaaaaaaaaaaaaaaaaggggggggggggtataatattaattctgggggggggggcaattttggggggcaagttttttgttgagaaagaagggaggctcgtccaaataaaaggggggttgtctcttaaaaatcacgacaggccgagcgcgggctgattaaaacaaaaagagcatcgtcgtgggtgtgggacaaaaatacaggttatgtggatgtgactattttggcggaggaggagagaacacacccatagcgggcgggggggggagaagctatgttgggggccggccaactcctagccaggaggtgatttgagcgctggctggagtggtcaattaaaacactggagaggggtgataatggggtggaaccagtggctgtattttgttctgtggtgggagaaaaagtgtgttgatggtggttttttgtgagaatattt

SEQ ID NO: 32772 - DNA, 859 bp, Homo sapiens
tcctacacccctgccagcggcaccatggcttccctctggctcctctcctgcttctcccttgtgggggccgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggtgactctggaggccccctggtctgccagaaggacggagcctggaccctggtgggcattgtgtcctggggcagccgcacctgctctaccaccacgcccgctgtgtacgcccgtgtcaccaagctcataccctgggtgcagaagatcctggccgccaactgagccccgaggtttcccttcggaccttggttcccaacaaaacctt

SEQ ID NO: 32773 - DNA, 853 bp, Homo sapiens
tcctacacccctgccagcggcaccatggcttccctctggctcctctcctgcttctcccttgtgggggccgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccgggggtgactctggaggccccctggtctgccagaaggacggagcctggaccctggtgggcattgtgtcctggggcagccgcacctgctctaccaccacgcccgctgtgtacgcccgtgtcaccaagctcataccctgggtgcagaagatcctggccgccaactgagcccgcagctcctgccacccctgccttaagatttcccattaaatgcatctgtttagaaaaa

SEQ ID NO: 32774 - DNA, 732 bp, Homo sapiens
ccacgcgtgcgagcggcatggcttcctctggctctctctgcttctcccttgtgggggcgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgggtgactctggaggccccctggtctgccagaaggacggagcctggaccctggtgggcattgtgtcctggggcagccgcacctgctctaccaccacgcccgctgtgtacgcccgtgtcaccaagctcataccctgggtgcagaagatcctggccgccaactgagcccgcagctcctgccacccctgccttaagatttcccattaaatgcatctgtttagaaaaa

SEQ ID NO: 32775 - DNA, 866 bp, Homo sapiens
ccacgcgtgcgagcggcatggcttcctctggctctctctgcttctcccttgtgggggcgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggtgactctggaggccccctggtctgccagaaggacggagcctggaccctggtgggcattgtgtcctggggcagccgcacctgctctaccaccacgcccgctgtgtacgcccgtgtcaccaagctcataccctgggtgcagaagatcctggccgccaactgagcccgcagctcctgccacccctgccttaagatttcccattaaatgcatctgtttagaaaaa

SEQ ID NO: 32776 - DNA, 1326 bp, Homo sapiens
tcctacacccctgccagcggcaccatggcttccctctggctcctctcctgcttctcccttgtgggggccgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggtgactctggaggccccctggtctgccagaaggacggagcctggaccctggtgggcattgtgtcctggggcagccgcacctgctctaccaccacgcccgctgtgtacgcccgtgtcaccaagctcataccctgggtgcagaagatcctggccgccaactgagcccgcagctcctgccacccctgccttaagatttcccattaaatgcatctgtttagaaaaaaacaaaaaaaaaaaaaaaaaaaaaaaaaaggggggggggggtataatattaattctgggggggggggcaattttggggggcaagttttttgttgagaaagaagggaggctcgtccaaataaaaggggggttgtctcttaaaaatcacgacaggccgagcgcgggctgattaaaacaaaaagagcatcgtcgtgggtgtgggacaaaaatacaggttatgtggatgtgactattttggcggaggaggagagaacacacccatagcgggcgggggggggagaagctatgttgggggccggccaactcctagccaggaggtgatttgagcgctggctggagtggtcaattaaaacactggagaggggtgataatggggtggaaccagtggctgtattttgttctgtggtgggagaaaaagtgtgttgatggtggttttttgtgagaatattt

SEQ ID NO: 32777 - DNA, 743 bp, Homo sapiens
tcctacacccctgccagcggcaccatggcttccctctggctcctctcctgcttctcccttgtgggggccgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgggtgactctggaggccccctggtctgccagaaggacggagcctggaccctggtgggcattgtgtcctggggcagccgcacctgctctaccaccacgcccgctgtgtacgcccgtgtcaccaagctcataccctgggtgcagaagatcctggccgccaactgagcccgcagctcctgccacccctgccttaagatttcccattaaatgcatctgtttagaaaaa

SEQ ID NO: 32778 - DNA, 1088 bp, Homo sapiens
caggaactaggaggttctcactgcccgagcagaggccctacacccaccgaggcatggggctccctgggctgttctgcttggccgtgctggctgccagcagcttctccaaggcacgggaggaagaaattacccctgtggtctccattgcctacaaagtcctggaagttttccccaaaggccgctgggtgctcataacctgctgtgcaccccagccaccaccgcccatcacctattccctctgtggaaccaagaacatcaaggtggccaagaaggtggtgaagacccacgagccggcctccttcaacctcaacgtcacactcaagtccagtccagacctgctcacctacttctgccgggcgtcctccacctcaggtgcccatgtggacagtgccaggctacagatgcactgggagctgtggtccaagccagtgtctgagctgcgggccaacttcactctgcaggacagaggggcaggcccagggtggagatgatctgccaggcgtcctcgggcagcccacctatcaccaacagcctgatcgggaaggatgggcaggtccacctgcagcagagaccatgccacaggcagcctgccaacttctccttcctgccgagccagacatcggactggttctggtgccaggctgcaaacaacgccaatgtccagcacagcgccctcacagtggtgcccccaggtggtgaccagaagatggaggactggcagggtcccctggagagccccatccttgccttgccgctctacaggagcacccgccgtctgagtgaagaggagtttggggggttcaggatagggaatggggaggtcagaggacgcaaagcagcagccatgtagaatgaaccgtccagagagccaagcacggcagaggactgcaggccatcagcgtgcactgttcgtatttggagttcatgcaaaatgagtgtgttttagctgctcttgccacaaaaaaaaaaaaaaaaaaaaaaagggtaactatgagagatggtggatatgttaacttgcttcgctataggaacctttgtgctatctatattatctatatgaatcccatcatatcaggttgtctacctta

SEQ ID NO: 32779 - DNA, 511 bp, Homo sapiens
gcccccccccaggagggttccccagggcaccccacccatcgtgctggttggcagccttgcctcccactgcggccatcacctcccaggatgctgggctggacccacgtgggcccaggtggtgaccagaagatggaggactggcagggtcccctggagagccccatccttgccttgccgctctacaggagcacccgccgtctgagtgaagaggagtttggggggttcaggatagggaatggggaggtcagaggacgcaaagcagcagccatgtagaatgaaccgtccagagagccaagcacggcagaggactgcaggccatcagcgtgcactgttcgtatttggagttcatgcaaaatgagtgtgttttagctgctcttgccacaaaaaaaaaaaaaaaaaaaaaaagggtaactatgagagatggtggatatgttaacttgcttcgctataggaacctttgtgctatctatattatctatatgaatcccatcatatcaggttgtctacctta

SEQ ID NO: 32780 - DNA, 999 bp, Homo sapiens
attgatagatatttgggccgtttccaccatttggctgtggtgaatcacgctgccatgagcgtgtgtgtacagaaattacccctgtggtctccattgcctacaaagtcctggaagttttccccaaaggccgctgggtgctcataacctgctgtgcaccccagccaccaccgcccatcacctattccctctgtggaaccaagaacatcaaggtggccaagaaggtggtgaagacccacgagccggcctccttcaacctcaacgtcacactcaagtccagtccagacctgctcacctacttctgccgggcgtcctccacctcaggtgcccatgtggacagtgccaggctacagatgcactgggagctgtggtccagacagaggggcaggcccagggtggagatgatctgccaggcgtcctcgggcagcccacctatcaccaacagcctgatcgggaaggatgggcaggtccacctgcagcagagaccatgccacaggcagcctgccaacttctccttcctgccgagccagacatcggactggttctggtgccaggctgcaaacaacgccaatgtccagcacagcgccctcacagtggtgcccccaggtggtgaccagaagatggaggactggcagggtcccctggagagccccatccttgccttgccgctctacaggagcacccgccgtctgagtgaagaggagtttggggggttcaggatagggaatggggaggtcagaggacgcaaagcagcagccatgtagaatgaaccgtccagagagccaagcacggcagaggactgcaggccatcagcgtgcactgttcgtatttggagttcatgcaaaatgagtgtgttttagctgctcttgccacaaaaaaaaaaaaaaaaaaaaaaagggtaactatgagagatggtggatatgttaacttgcttcgctataggaacctttgtgctatctatattatctatatgaatcccatcatatcaggttgtctacctta

SEQ ID NO: 32781 - DNA, 450 bp, Homo sapiens
agaatcacttgaacccaggaggtggaggttgcagtgagccgagatcgtgccattgcactccagcctggacaaaaagagcaaaactccgtctcaaaacaaacgaacactctcagacgcctcgggaggggatggctgggaggtgagcctgcctgacttgagtctccactgctttgtcaaggtggtgaccagaagatggaggactggcagggtcccctggagagccccatccttgccttgccgctctacaggagcacccgccgtctgagtgaagaggagtttggggggttcaggatagggaatggggaggtcagaggacgcaaagcagcagccatgtagaatgaaccgtccagagagccaagcacggcagaggactgcaggccatcagcgtgcactgttcgtatttggagttcatgcaaaatgagtgtgttttagctgctcttgccacaaaaa

SEQ ID NO: 32782 - DNA, 913 bp, Homo sapiens
gaattaaactcactagaagtttcagccagatttcttcctgaatggttcagacagttgcaaacaccagactataggctcgcttttgtttagtgcatcttccaacaggcagtcatttgttcatgtcactcagaaaaataaaatttttagcatttgctgaacatacacatattcaaataaacatttaaatattcccctacttctatataaagaaagaaaaacccaggcaaattttaaatgagccatattttgttgattaatttttagcccaattataatgcaatgagaaaaattaattttactaaattttgattctgtagaaaagtaatagctgtttagcactcccttattcaaagaacaaatttagtatttcttgaaatacttttcttcattgtagtcaaatcacatctacatatctaaaggaaaagttgactggttttcctaagtaagtatatattaataggaacaagaattttagtctccatactttaaccatactctaagctgtaaatgtccagtgagtttggagctgtaagcaaaaggacctccttttgaaatgcctgttttaaaacatcaaatggtatgaaatcctttaacctcatgcagttacatttattatgaaatatttcaaacatactgcaaaggtataacgaatactttggaataatctggtttttgaggtaggagttagaaaatgttccatgggtaactcatttgtgcattttagaactacttgaaactctgtaccttcaaataaaaagtagagtggggtggaagtagggagagcattaggaaaaatggctaatgcatactggacttaatacctaggtgatgggttgatacgtgtagcaaaccaccatggcacatgttcacctatgtaacaaacctgcacatcctgcacatgtaccccggaact

SEQ ID NO: 32783 - DNA, 808 bp, Homo sapiens
gtaaatttatggtcaatatgcctccagatcagaggtcctgctgttagagagttttctttttttgctttagtggtacacaggaattctcccccagccccctcaagatactcacacatctttttaaaatttgcacctttttttcagtctggtttcctatggtgaaggggaggctaggaaatgcccaataaatcatctgtctgtcttcactcaattgaaaggcaggaaatgcagagaacagtcacgttacctttccactttgcatataacaagagctatcaggacctgttcctttgaaggggaggcccttctgacagcaatattaaattttcgaggccactggagtttgtttcttgggaccagacccaaagtgggcaggcatgtgggatgttggctctttcccctaccagccccttctaggagtaacttcttgggcttaccctgggaaatctactcagtcagcaatgatttaggggctccatgtgcacagcaccattgtaagtctatgtggattaaaggaattctactcttgagtcctaattcttaacaaatttacatctacagacagtcctagacttataatgattcaactaaatgattccttgactttatgatggtgtgaaacttccaattttaacacaatgtacagtattcaataaacatgagatattccctactttattataaagtaggctttgtgttagatgattttgcccattgtaggttaatgtaagtgctctgagcatgtgtacggtaggcgaggctaagctacagaggtttggtaagttgggtgaattaaatgcattttcaa

SEQ ID NO: 32784 - DNA, 410 bp, Homo sapiens
gccatggctgtaacttgagggagccgccctccttgggcctcagtttccccctctgaagccagggagctgggccttcctctggacttggtttgtccagggctcttggtgggaggtgcccacccttcctgagagaatgggcccacttggtaggacctttttctgccccttctagggccagcggaggggcccgtgctgggtctgcggagagcaggtctcacagccacaaggggcttccaggtgggaagggaccccaggttcacaccatgactctggcactgtgaggggcgatccgcacctcctctaggccttaggcaggtcctctctgtccagccagggcccctacctgtcatctccattttcaaaggggcaagagcacacgtcgacgcggccggaatttagtagtagtagta

SEQ ID NO: 32785 - DNA, 110 bp, Homo sapiens
gcataataatgagacacaacttcagtttagaaaatatatttttatttttattctatgtatgtactgaataggggctacgacataaatctagctagtcttattttttttcc

SEQ ID NO: 32786 - DNA, 1121 bp, Homo sapiens
gcgctatctcggctcactgcaagctccgcctcccgggttcacgccactctcctgcctcagcctccttagtagctgggactacaggcgcccgccaccatgcctggctaatttttttgtatttttagtagagacggggtttcaccgtgtttgacaggatggtctcgatttcctgacttcgtgatccgcccgcctcggcctcccaaagtgctgggattacaggcgtgagccaccgcgcccggcactatttgtgtttttaacaccattctcccccacttctctcctgggtgacataagagagaaataacctgtagtacagcagctaaagtattctcctttcagagaatttttttggaggtctctaatatatatttcccccttgtctctgtgatctcttatttatactatattattgtcccatgtactttctaaactgagcttggaacatttagtattcctgcaattggacttcccacttaacaattatacagactttgcttttagaaatagattaggttccaaacagaaagttcaagtgtaacaacaacaataaaaatagattatgaaacaggctataattggctcttttggatttgataggggcaagatgaaaggcaactttcttgcttttgaaatcatgttgggtaagaggtaaggaatccagctacaattttattagtgcttgaaacgggcttccttgaattctccaggccctatcattttttttttcttactaatcagaagagagctggggtagaagccccatgtttgtattccatgaaacacgtcgggttggagtaaaggcaaaaacagctagacacaccaggtgtgtctgtttgacatttataagctggcactcatcaacactcctgtttctcctttctctgggacgtgtggattaaggggtgtgagttgtgggaagaattgccctcgtacctcctggatttattatttttctcaaataccaaccagtaagatcccaaataacttgagaaaaattgtttcctgatctgtccacttctggtgtcaaagattttactcatcttcttagtacattctatgtattttatatgtataattttatacaattaaaaatagatttttgtctagtgaaaaaaaaaaaa

SEQ ID NO: 32787 - DNA, 2601 bp, Homo sapiens
  misc_feature (561)..(561): n is a, c, g, or t
  misc_feature (1092)..(1092): n is a, c, g, or t
  misc_feature (1186)..(1186): n is a, c, g, or t
  misc_feature (1449)..(1449): n is a, c, g, or t
  misc_feature (1477)..(1477): n is a, c, g, or t
  misc_feature (1846)..(1846): n is a, c, g, or t
  misc_feature (2041)..(2041): n is a, c, g, or t
  misc_feature (2070)..(2070): n is a, c, g, or t
ggcgccacagtcacttttccagatctaggagcaccatggacacctcgtcagagatgctggtacggtttggacggcgctgtggacgggcgaaggaaagtacagtcttaggtatgtctttatcagcagtgtgaaaacggactaatacagtaaattggtaccagcagagtggggcattgctgaaaagataactgaaaatgtggaagcgactttggcactgggtaacaggcagagattggaacagtttgaagagctcagaagaagacaggaaaatgtgggaaagtttggaacttcctagagacttgttgaatgcctttgaccaaaatgctgatagcgacatggacaataaaatgcaggctgagatggtctcagatggagatgaggaactttctggaaactggagtaaaggtgattcttgctatgttttagcaaaaagactagcgtcattttacctctgccctagagatttgtggaactttgagaaagatgatttagggtacctcgcagaagaaatttctaagcagcaaagcattcaagaggtgagttggatactgttaagggcantcagttttaaaagggaaacagagcataaaaattcagaaaatttgtagcctgatctggcagaagaaatttctaagcagcaaagcattcaagaggtgagttgggtactgttaagagcattcagtttcaaaagggaaacagagcataaaaattcagaaaatttgtagcctgactatgcaatagaaaagaaaaaccagttttctggggagaaattcaagccagctgcagaaatctgcataagcatcaagaagcctaatgttaatccccaggaccatggggaaaatgtctccaggccatgtcagagaccttcacagcagcccctcctgtcacaggcccagagatccaggaggaaaaaatggttttatgggccaggaccagggtccctgtgctgtgtgcagcctatagacttggtgccctgtgtcccagctgctccagccatggctgaaaggggccaatgtagagctcatgctgtggcttcagagggtggaagccccaagccttggcagcttccacatggtgttgagcctgtaggtncacagaagtcaagaattgaggtttgggaacctccacctagatttcagaagatgtatggaaatgcctggatgtccaggcaaaagtttgctgcagnggcagggccctcatggagaacctctgctagggcaatgcagaagggaattgtggggccggagctcccacgtagagtccctaatggggcattatctagtggagctgtgagaagagggccaccgtccttcagaccccagcatggtggatccactgacagcttgcaccatgcgcctggaaaagccgcagacactcaatgccagtccgtgaaagcagccaggagggaggctgtaccctgcaaggccacaggggcagaactgccaaagnccatgggtccccaccttttgcatcagcntgacctgaatgtgagacctagagtcaaaggagatcattttggagctttaaaatttgattcctgctggattttggacttgcatgggtcctgcagcccctttgttttggccaatgtctcccatttggaatggctgtatttacccaatacctgtacccctatcgtatctaggaagtaactagcttgcttttcattttacaggctcataggcagaagggacttgccttgtctcaaatgagactttggactatggacttttgggttaatgctgaaatgagttaagactttgggggactgttgtgaaggcatgattggttttgaaatgtgaggacatgagatttagagggggccaggggcagaatgatatggttnggctgtgtccccacccaaatctcaacttgaattgtatctcccagaattcctacacgttgtgggagggacccagggagaggtaattgaatcatgggggctggtctttaccatgccattcttataatagtgaatacgtctcatgagatctgatgggattatcagggacttccgcttttgcttcttcctcgttttctnttgctgccaccatgtaagaagtgcctttngcctctcaccatgattctgaggcctccccagccatgtggaactgtaagtccaactaaacctttttttctctccagtctcaggtatgtctttatcagcagcatgaaaatatactaatacatatttcatgttaatgggctgggagatttagtattgttaagatggtttgaatatttgtccccttcaaaactcatgttgaaaattaattcccaaaatgacagtattgagaggtggggcctttaagaagtgattgggtcatgagggatctgctttcatgaatggattagaaatggggtcttgctgtgaatggattaatggcttatgctggaattgagactgttggcttcataagaagaggaagagagacctgagctagcatcctcagcccccttgccatatgatgccctgcattacttccagactctgcagagagaccttaccagcaagaaagccctcaccaaatgcagcccctcaaccttgcacttctgagcctctataattctaagaaataaaatcctgttctttataaatta

SEQ ID NO: 32788 - DNA, 1799 bp, Homo sapiens
ggcgccacagtcacttttccagatctaggagcaccatggacacctcgtcagagatgctggtacggtttggacggcgctgtggacgggcgaaggaaagtacagaaataagaaactctgaagaagatcaagttctctatctgcctcttctacctagcaaagtagatctccagcaggtcaccataattccacacgatgagtggaaaaggattcaagatagccttgacaggttgacaagagaagcagcatgcctccgtgcagaaagaaaggcaaagaaagaaatgcatttgcgatctcaagaagtggtaaaacactggactaatacatatgcagggatgaaagaacagaaacttgaagccaaaaagaagcgtgatgaagaaatagaggcagaaagacaaattcttgatctggaagaagaaatatacaaacaaggaaaaagaaaaaaggccattgaaaatgcaaagcaatatcaattttaccagacagaaagagtgaaaaactttcattcgggacttcttcttagtagagttatgaaagaacgtgatgcccagattgaattccgaaagagtaagataaaatcagataaaaaatgggaggaacagttgaaactcaacattgaaaaagcttttaaagaagaacaagaaaaagcagaaaaacgacacagagaaagggtggctcttgccaaagatcatctaaaacaaataaaggaacatgaggaagaagaggaaagaaggaaaaaatatgaagaaaaagatgctgaggaaataaagcgacagaatgcattatatgaaattgaaatgagaaaaaaactagaaaagaaaagagaagagatgcatgaaagcaggagacggtttcttgaacatatgcaggataaacatattatcaaagctgtagaacagcagcagcaagaggaagaagatgaaaagatgagaaaattcatcaaagcaaaaaagcgtcttatacaaatggggaaagaaaaagaggctgaaacacacaggcttatggagaaacgaagagaaagaatacataacttcctgagtgaactgttgaaagagaaacttgacaatgaagatatgattattgctagagatattgcagaagctgaggctgaatgggaaaaaagagaaagagaaaaagatgaaaaaaacaaagcagaattaaaaacaattgcagaatatcgagccattgtgatgaaaaataaagaggaagaagaaagacaaagaaaaatagaggctaaagaacaattgctggctgtcatgaaagcagatcagattttctgggaacatgaaaaggagaaaaaatgcaaagctgataaagaacatcaagaggttcaagatgcccatattcagcaaatggccaaaaataagtttaatgcaaagcaagcaaaacaagcagaattagattattgcagacttactgaagctcttgtggctgaaaaggagaaagaatttcaggactatgccagagaggtaattgaacttgaatcggaaacaacaaataaatatatttaccctcttgtaaaagctgtacaggaaggacctggaggtggccgtggaccagtgtttgtggacagaggtggattaagacccagctatcaggcaaatgatgttactggagtccagctccctttttataactctcagggaccaaaatataattttcaaaagtcaaagagaaggctaggttttacatggtagaaaaaaattatttttaacattgagaagactaagttgtagcatatatgagcttcaaatataaatggatttcagttaataaagctgttcttcatctaagtacaaata

SEQ ID NO: 32789 - DNA, 1799 bp, Homo sapiens
ggcgccacagtcacttttccagatctaggagcaccatggacacctcgtcagagatgctggtacggtttggacggcgctgtggacgggcgaaggaaagtacagttatcatgccaatatcggaacttctcagacgaatatcacttaaactgttccccaaagtagatctccagcaggtcaccataattccacacgatgagtggaaaaggattcaagatagccttgacaggttgacaagagaagcagcatgcctccgtgcagaaagaaaggcaaagaaagaaatgcatttgcgatctcaagaagtggtaaaacactggactaatacatatgcagggatgaaagaacagaaacttgaagccaaaaagaagcgtgatgaagaaatagaggcagaaagacaaattcttgatctggaagaagaaatatacaaacaaggaaaaagaaaaaaggccattgaaaatgcaaagcaatatcaattttaccagacagaaagagtgaaaaactttcattcgggacttcttcttagtagagttatgaaagaacgtgatgcccagattgaattccgaaagagtaagataaaatcagataaaaaatgggaggaacagttgaaactcaacattgaaaaagcttttaaagaagaacaagaaaaagcagaaaaacgacacagagaaagggtggctcttgccaaagatcatctaaaacaaataaaggaacatgaggaagaagaggaaagaaggaaaaaatatgaagaaaaagatgctgaggaaataaagcgacagaatgcattatatgaaattgaaatgagaaaaaaactagaaaagaaaagagaagagatgcatgaaagcaggagacggtttcttgaacatatgcaggataaacatattatcaaagctgtagaacagcagcagcaagaggaagaagatgaaaagatgagaaaattcatcaaagcaaaaaagcgtcttatacaaatggggaaagaaaaagaggctgaaacacacaggcttatggagaaacgaagagaaagaatacataacttcctgagtgaactgttgaaagagaaacttgacaatgaagatatgattattgctagagatattgcagaagctgaggctgaatgggaaaaaagagaaagagaaaaagatgaaaaaaacaaagcagaattaaaaacaattgcagaatatcgagccattgtgatgaaaaataaagaggaagaagaaagacaaagaaaaatagaggctaaagaacaattgctggctgtcatgaaagcagatcagattttctgggaacatgaaaaggagaaaaaatgcaaagctgataaagaacatcaagaggttcaagatgcccatattcagcaaatggccaaaaataagtttaatgcaaagcaagcaaaacaagcagaattagattattgcagacttactgaagctcttgtggctgaaaaggagaaagaatttcaggactatgccagagaggtaattgaacttgaatcggaaacaacaaataaatatatttaccctcttgtaaaagctgtacaggaaggacctggaggtggccgtggaccagtgtttgtggacagaggtggattaagacccagctatcaggcaaatgatgttactggagtccagctccctttttataactctcagggaccaaaatataattttcaaaagtcaaagagaaggctaggttttacatggtagaaaaaaattatttttaacattgagaagactaagttgtagcatatatgagcttcaaatataaatggatttcagttaataaagctgttcttcatctaagtacaaata

SEQ ID NO: 32790 - DNA, 1257 bp, Homo sapiens
ggcgccacagtcacttttccagatctaggagcaccatggacacctcgtcagagatgctggtacggtttggacggcgctgtggacgggcgaaggaaagtacagaaataagaaactctgaagaagatcaagttctctatctgcctcttctacctagcaaagtagatctccagcaggtcaccataattccacacgatgagtggaaaaggattcaagatagccttgacaggttgacaagagaagcagcatgcctccgtgcagaaagaaaggcaaagaaagaaatgcatttgcgatctcaagaagtggtaaaacactggactaatacatatgcagggatgaaagaacagaaacttgaagccaaaaagaagcgtgatgaagaaatagaggcagaaagacaaattcttgatctggaagaagaaatatacaaacaaggaaaaagaaaaaaggccattgaaaatgcaaagcaatatcaattttaccagacagaaagagtgaaaaactttcattcgggacttcttcttagtagagttatgaaagaacgtgatgcccagattgaattccgaaagagtaagataaaatcagataaaaaatgggaggaacagttgaaactcaacattgaaaaagcttttaaagaagaacaagaaaaagcagaaaaacgacacagagaaagggtggctcttgccaaagatcatctaaaacaaataaaggaacatgaggaagaagaggaaagaaggaaaaaatatgaagaaaaagatgctgaggaaataaagcgacagaatgcattatatgaaattgaaatgagaaaaaaactagaaaagaaaagagaagagatgcatgaaagcaggagacggtttcttgaacatatgcaggataaacatattatcaaagctgtagaacagcagcagcaagaggaagaagatgaaaagatgagaaaattcatcaaagcaaaaaagcgtcttatacaaatggggaaagaaaaagaggctgaaacacacaggcttatggagaaacgaagagaaagaatacataacttcctgagtgaactgttgaaagagaaacttgacaatgaagatatgattattgctagagatattgcagaagctgaggctgaatgggaaaaaagagaaagagaaaaagatgaaaaaaacaaagcagaattaaaaacaattgcagaatatcgagccattgtgatgaaaataaatgaagaggcgcccgctcctttaagagagggaaatcctgaacctaggtcactgaccgctg

SEQ ID NO: 32791 - DNA, 350 bp, Homo sapiens
  misc_feature (347)..(348): n is a, c, g, or t
caagtgtgtgttttaaagcacttaaaatgtttattttttaataacttttttctagactcttacttataggattcaattggactgcaaacattttaaaatttataatttaaatgtaaatttcagcttcaccctgtctgaataatcacagattgcatataagaagattcaaattaatgaggttttcttttctaagaactactaagctaatataagaaaaatgtatacatagtataaattaaaagaacatacgggtttggtttttttttttttttgagacggagtctcactctgttgcccactgcactccagcctggtgacagagggagaatcagtctaaaaaaaaaaannag

SEQ ID NO: 32792 - DNA, 867 bp, Homo sapiens
cctcatgaaagctcaatattcatttaccatatctttgataaaaatgacaggaaaggtctgtgctgttgtggaccttccattttaatacttactgagggagtgcatagattacaaaacaccaagtaaataaaaaagataattacagagtatgatatgtgtcatgaaagaaataaacgggactaagaagaaacaatatgttaggtgttttgggaagaagaaggctgcatttaaactaagacctaaaggatgagaaagagccagccatcttcaaagtgcatttaacaggcagagggaaaggcaagccaaaagtccctcaggagaaaatactttaaaaccagtatttcagcaaaagaacattatatcaaattaaacattttagttagaaccctcaattatctaatttaaaggataagagtttggggtattataaaattcaaggaaaattaaataggaaagtggtctatggaaaaaaatagaaatgtcacttctataacagtcagactaatatttgccttttctttaatcatgtcaaaatttactatgtgtggtaacaacatatttatgacagatcgaaagaattccttgggataacattatttttcaaggcttcctgaaaaaggcatggatgtacggaaacccaggggtctagaggttgcagtgggaaagtatctaagggaagagaaaacctagtttgacctggaacattgattaaaaggagatgctatcttgagcagctaatgaggattttttaattggaaaaaatcctagataatgtagaaacggaatgattggcctattttaccagccctctctaccagaatagcctccaagtaaacttccaaagttaaataacacaaaactctatct

SEQ ID NO: 32793 - DNA, 234 bp, Homo sapiens
tttaattccagtaaaatatacaaacttttctgtggtatagctctatttttcctctcttttgtgctaaaattgtcatatatatgtgtatatatgtatatatctacaaatacataaaataaacccaccaatacagtagtaaaattgtttcccttaggatccattgatagatatggaattccatatatatattttatatatatatatattttatatatatatatattttatatatat

SEQ ID NO: 32794 - DNA, 416 bp, Homo sapiens
taaggacgggaccttttgtccccaagaggcagcctggtgtgatggctgccagggtcttagctgtctgacggggcgcttttcaaatcccagggtctttccaaaggtggatgctgggcccagcccacctcccagggaagccctaggaccccatggcccctgggtggggcgggggatgtcactggccaggcagcaccctgagccaggtgacacatctgtggaggctgtctgtctctggtgtctgctgcatggcccctgaagcctccaggggtgaggcggaaggcgagggaggaggagggttgtgggcatcttgcaggtgaaggtgttgggggggcttggtgggaggagggcaggggaggacagggaaaggttcagagggaagggaccgcctggaccctccagagcaggggtgtgggagg

SEQ ID NO: 32795 - DNA, 359 bp, Homo sapiens
ctttaaggttcctagagtggtggttcttacaaaccacactccctttgcactaagtcaaaatgtgtattagttgctgcgtttagaagttattagatatcttcctgcattcacagaatcatttttaagttacaatattcagttaacaatattatttttccatttgaaaagtctaataatattattcaatggggcccttcctgttataagaaaatagctgtcttatgtgtagacttcagtaacaagatgttcccacatataaggacgatgtgtaaatgtgtggcttagcttatgtaagaggggagccatcaacgtttggtattctaggttatgtcaatctaaagatacttgggtgatggaga

SEQ ID NO: 32796 - DNA, 504 bp, Homo sapiens
ctgccttctagcaagagaaagatagatggtcctcaaaatcctaatttttctggaacctattggagagctaatgctgcaggacaacaagtagcctggcatctgaggaaagacaggtgcctctgcggacagatagagaacaagcatggattcacctgtgtaagagcataagagtaagagaaggccaccatacaagtgaataaaaagaagtcacagtgacttttaattaattttcaaagactgcttctctgatactgtgagagtatggaagctatgaagacagccagttgcaggcttttctccatagacttcactatgtgctgatgaaaaaagtttattggcagggcaggtactaatatagactactttggagatgcagcctgaagaagaggtgcatccactgctgtaggaaacacaggaacccatctttggtttcttctcacataaggaaaaaagacttttaagatgctggggaatagcagaaagctcttggcccagtgcaaggag

SEQ ID NO: 32797 - DNA, 292 bp, Homo sapiens
taggtagaatcatgtcatgttccaaatttcttgcttatcctcagcaacaatatccatgatgatcatagcttgatgttttcactatatgtttcctaaccgtttaaaaataaacacgtatgcatgtggaaggatgaacaaagctccactttgaagctttttctgtttaagcttagaaattgctagcagcacatgtatctatcttgggctggcaaacagcttcaatcaaaggatggcaaattttaacagtcctttcaaacatcaaagctgtcctttggattttcaaatgttggca

SEQ ID NO: 32798 - DNA, 95 bp, Homo sapiens
cccagcactagattctagagaaagtggtgaacgaaataatctacagtatagtgcacgacctgaccagcttcccaagatgtggagatggcaggcat

SEQ ID NO: 32799 - DNA, 417 bp, Homo sapiens
atggaggtggagctgatgacatcccacgaggtgcaggctgctgggaggcaggcacactggaccagcggagagggatccgtacgtagcaaactgtgcccatagtgagcaaacagccttgagccaacagcaacagcactgctgggcacagagggtaaaaataacaactccctactggggttgagtctgccagaccctggcaaagttcatttctttcaataaatccagcagcgtcccctttgataaatactgtcaaagctggaacatgtgatgctaacaaaatatggttttaatttggggcccactgcgctcatggttaaatactgcatgtgtgtatacacaagcagactcacagcgggccaagttaatatgcctgggctgagaatggctaaacccataaggattcagttatacagattt

SEQ ID NO: 32800 - DNA, 394 bp, Homo sapiens
ttccaagtccatttcctggaggtaaacattccttggtgggtgtgctttggtctgcaaattgactgtcaattctcagaagagatctgtcttgctgcacatagttagaagaacgtgccctgcagggaatgtctagtgagtgggggtgaaaggttatatttgcatttatgaagggctaagcaggaaacagggaacaaaaggaaaggggagataagagaaaataataataaaaaaatagtaactcattccctgtttcttagaaaaaatggggcactctgttacaaacccaggaattcaaggctgtagtgagttatgatttgccactgtactacatacctcctaagtgaaggattgagactgtgtatctaaaaaacccaaatgcaaataacacacacac

SEQ ID NO: 32801 - DNA, 202 bp, Homo sapiens
ttccaagtccatttcctggaggtaaacattccttggtgggtgtgctttggtctgcaaattgactgtcaattctcagaagagatctgtcttgctgcacatagttagaagaacgtgccctgcagggaatgtctagtgagtgggggtgaaaggttatatttgcatttatgaagggctgtcgggctagtcgggggggtaccgagct

SEQ ID NO: 32802 - DNA, 453 bp, Homo sapiens
gatgtgtaagttgcccaggtttaccagcccaggaacctacttcattaatcaagagccttcatccttgacagtattcagattaaatagaagatatctattatattttggtattataagagtattccttatcagaaatgtttgagactacaggtgttttgcattttggatttctttcagattttggaatatttgcattatatatttgctggttgaacatccatatctgaaatctgacatgctccattgagcatttcctttgagcaccatgttgatttacaggaatcatttataggaattgataatttctttctctccaagagatggcagcatttcagtttgaaaaacctgacatttgttgtgtttcataattgattcatcaatttttctaaagctagggcaaatccatgttttttattttattttatttttttaggagcagaggtttaataggca

SEQ ID NO: 32803 - DNA, 461 bp, Homo sapiens
aggctcaagccaccctcagaggctgcactcagaaagaagcacgctgaagacccatacatgcaatgcttggttctggaagcttgctcaggaattcagatgcagtgggagacaaaaaggaatggaatcctgctgaataactgggcaggaagtgatcccagaatatgctagcttccctccctctgagtctaaagatctagtaaggagcccacccttggatcttggagagagctcccttttaatatcgggacacaaaccgacattttgagtaaacctcatagtcgaataccacggagtactgtttgtgacaaacaggaagtcattaattctttattatatttttgctctaccgaaagctgttgaccaaaccacctggcttctccgagaaaacccttatctgctacatccaggaccaagcagctggatggtttattgaaaatgccaaagggatcaatcataaaacg

SEQ ID NO: 32804 - DNA, 528 bp, Homo sapiens
tgcaatggcactgtatcgactcagtacaacctctgcttcccaggttcaagcgactcctctgcctccacctcccgagtagccaccatacctggctaattcttatattttaatagagacagggtttcaccatattggtcaggctggtctcgaactcctgacctcaggtgatctgcctgcgtcggcctcccaaggtgctgggattacaggtgtgagccaccatgcctggccgaggtgattgcactttaaagatttcttcgttcatagtgctggcaaaaaattttttactgaatgactgatacaaatcttggaacctgtgtttggatgacaagattaattcataatttttgcagaaaataaatatagcatagtgctcatgtacaggttaacctcaagatcaaagaatttgggccagttgtagtaagtcacacctttaatcccagtactttgggagcctgaggcaggaggattgcttgagccaaggagttcgagaccagcctgggcaacatagtgagacctgtctctttttaa

SEQ ID NO: 32805 - DNA, 537 bp, Homo sapiens
atgagacttctcatcctggccctccttggcatctgctctctcactgcatacattgtggaaggtgtagggagtgaagtctcacataggaggacctgtgtgagcctcactacccagcgactgccagttagcagaatcaagacctacaccatcacggaaggctccttgagagcagtaatttttattaccaaacgtggcctaaaagtctgtgctgatccacaagccacgtgggtgagagacgtggtcaggagcatggacaggaaatccaacaccagaaataacatgatccagaccaagccaacaggaacccagcaatcgaccaatacagctgtgaccctgactggctagtagtctctggcaccctgtccgtctccagccagccagctcatttcactttacaccctcatggactgagattatactcaccttttatgaaagcactgcatgaataaaattattcctttgtatttttacttttaaatgtcttctgtattcacttatatgttctaattaataaattatttattattaagaaaagtt

SEQ ID NO: 32806 - DNA, 557 bp, Homo sapiens
tactactactaaattcgcggccgcgtcgacatatttgaaaataagctgcagaaaacatgacatttcatttgtaaatatttcaacacacatttcctaaagataaaacaaaaaatatatataaccacaatattgtaatgacacctaagaaaaaaatacagttcatattttaaattccataataactaaggaggctggtaagaggattgcttcagggctgggcacggtggctcacgcctgtaatcccagcactttgggaggtcgaggtgggggatcatgaggtcaggagattgagaccatcctagctaacacagtgaaaccccgtctccactaaaaatacaaaaaattagccgggcaaggttgtgagcgcctgtagtcccagctacttgggaggctgaggcaggagaatggcatgaacccaggaggcacagcttgcagtgagctgaggtcacgccactgcactccagcctggacgacagagcaagactccgttccccccaccccctcccccaaaaaaagaggattgcttcaggcaagggtcttcagactagcctggacaa

SEQ ID NO: 32807 - DNA, 1554 bp, Homo sapiens
taaaggggaggattcctgatctttaggggcgcggcgcgagggcagggagtgggtgtaagagcttctggcctacgtgcggggcggagatgggggcctctgaggcgggtttgagcgagtgtgaccgagtttgtcctcaaagtttgacctgatgtttgggattgttgagtgaatgtgaaactgggtgcgggattgtgtgtgattgtgcctaagagggagatgtaggagaccagcattgaggtataacgtttgagctgcacttcccttgtcgaaagtgctgataattataacggtgccatcttcctggagcgtcttttttacttgaaaattgaaggggtggaaaagctaagtggtgaataattttaaaacgagtttttatataaaagcatttctttttaattggagtggcatgcaaatcaccgtgactttttttttttaattaaacgagagtgtttcgaaggaactttagtttcggggtgcctacttcagactattcaagtccccatctttggggtacttaaatagggctgttaagcaaagccctagactaaacagcattgtacgctttgagaagcaatcccatataacggcgcccaggatgagggagtcaacggttttaggttaggcacagttatcctcattttttgaagaaagcttaattgttgcagtgtttatctatgagtctggactaaatcctaggtgtcttaattccttaatgagtcgaggcgttctcaggttgtatggattttgtgaagtaatggagaatgctactgacgtctccaaagatgcgttttctaaggaaatcaccccgcccccgctgtcgtcattgacatagttttaaattacaaaaagttaaataaagtaattgggtaccaagttaatatctataaataaatagccttctaatttacaaatatcagttagaatacatagttgaagaaaactaatatttacaatagcagtaaaaagataaagtattgtggaagaaacttaaaggttcagaactattaggaaagaactttaaaatactactaaggggcataacaaatgtgaacaaataaatataccatgtgacattaagaagtgtgcgcaaacttaagtgaatgtattaatttactgtgatcttggtcgggtgcggtggctcatgcctgtaatcctagcactttgggaggccgagatgggcggattacctgagatcaggagttcgagaggagcctggccaacatggtgaaaccctgtctctactaaaaaaaaataaaataaaaaaatacaaaaactctccggggtcttttctttgttccgggtggggggaaaaagaaggttatgtgaaagggccccttggttccttatcttgtttttcctgaccccagtttttttgtttccaaggggggaaaatttctgcgcggttccccctaataggaggagtccgtaattaattttccgaataaagcccgggtttaaccctgtctttttgattctccggaaaacgcacagaacaacgagcaaacacagagaaaacaaaggacagcgaacaaacaaacaaagcaacgaaaccag

SEQ ID NO: 32808 - DNA, 384 bp, Homo sapiens
gcttgtctcgaactcctgacctcaggtgatctgcccacctcagccttctgaagttctgggattacaggcatgagccactgcgccggcctgctttaccatcttggctcatgtgcatttattgaatgcttactgtgtgcccaacactgtatatgtgacaacatacatgaaagtaaatattaactgatagcatatatttataacatatattacaatacgtaatatatgcaaataaacgaaactgcggtgaaatgtcagttattattagtaaaaattagttcttcttttcatctgtatgagacatgatgttccttcctgcacaggggtaggaggtcaggaccttcggtctctgcctgccccgtcggccccctgtgtttggcctgagtg

SEQ ID NO: 32809 - DNA, 1010 bp, Homo sapiens
atcctgttttttatgagatacctcagtgaaaaaacattcatagcattcttattattgaagtcaaaagatgacacagatgaaataaagtactgactctaagcctaaaaatgcctaacttacaactctaacatgagcaaaccatcatcagttatattaggttaatatatggtataagtagtatggttctactgttttgttttaatttgcaaattattttggctttgcaatgatataagaattataagcctgttctagagaagtaccatgcaacattgtacctatagttaacaatatggttaacaattttaacaatttaaagtgtattgtacactttaaaatatgccaacagggtggatttcatgttaagtgttcttaccacagttttaaaaagaattattagcatgaaatgtttacatatctgggtttctattttgtagatatgtaagtaacattgtaataaaaacactgtaactctccaatacaaaaagcagcttcctacacaatgcagccccatacccatacccaacccattgacccatcaagccagcacccatcctttcttggcactctgtatctcagtacacattctaccttcaaaaacagctaagtcaaacgtgtcaaaatagctatttcctcttgagtttgagcatctgcagttgcccagccccaattctttatttggaaataagtattaggagaaacatatctagcatagtgatattgatttgtaatttcctcaaatagacattcactttagatgactacaaaagctaaatagagctcaggagctcgagaccatcctgggcaacataatgaaacaccatctcttaaaaaaaaaaatacaaaagttagctgggtgtggtggtgtgcacccatagtcccagctactcaggaggctgaggtgggacaattgcttgagcctgggaggtcaaggctgcagtgagctgtgatcacaccactgcattctggcctgggtgacagagttagactgtgtctcaaaaaaaaaaaaa

SEQ ID NO: 32810 - DNA, 630 bp, Homo sapiens
taatttacctactgaagcatagtcagtagccactgtagcatctgaagaacatatgatggacacaccactcccacactcagcacccagataagcaaggcaggcagcaatgcagatgagctatagttatcccaggaaatcactttgacttgtaaagtgtgaaaaggactggccttcacctatcattctttctatagcagagctccctaaagctcagaaagccacagctggctgggatgtcatggctccacctattataatcccaccactttggaagacagaggcgggtgggtcacttaagcccaggagttcatcactgagcccaggggtttgagaccagcctgggcaacatggcaaagccccgtctccacacacacacccacacaaatagaaaaaaatttagtcgggaatggtggcacacacctatagtcccagctactcgggaagctgaggtgggagggtcacctgagcccaggagtttgacgctgcagtgagccttgatgacagcactgcactccagcctgggcaacagagtgagaccttgtctccaggaaaaaaaaaaaagagaaagccatccccttccttgacatcatctgtaatgagtaaacagacattaaaacagtaagagtaaac

SEQ ID NO: 32811 - DNA, 805 bp, Homo sapiens
taatttacctactgaagcatagtcagtagccactgtagcatctgaagaacatatgatggacacaccactcccacactcagcacccagataagcaaggcaggcagcaatgcagatgagctatagttatcccaggaaatcactttgacttgtaaagtgtgaaaaggactggccttcacctatcattctttctatagcagagctccctaaagctcagaaagccacagctggctgggatgtcatggctccacctattataatcccaccactttggaagacagaggcgggtgggtcacttaagcccaggagttcatcactgagcccaggggtttgagaccagcctgggcaacatggcaaagccccgtctccacacacacacccacacaaatagaaaaaaatttagtcgggaatggtggcacacacctatagtcccagctactcgggaagctgaggtgggagggtcacctgagcccaggatgcaatggcacgatctcggctcattgcaacctctgcttctcaggttcaagcaattttcctgcctcagcctcccaagtagctgggactacaggtgcgtgccaccatgcctggctaattttttgtatttttagtagacatgttggccagactggtctcgatttcctgacgtcaggtgatccatttgcctcggcctcccaaagtgctgggattacaggcgtgagctgccacgcccggtcatgtaacagttttaaaaagcccatacggtcatactgaatatagacatagacagagttaatcaaatacatcagagactgagtttgtgaagttaagg

SEQ ID NO: 32812 - DNA, 322 bp, Homo sapiens
cttcctttccacatgtctcaccagaaaaacagcaatggtgaaaagtcaactctgtttttaatgggccactttgtatattttaactgttaaaataatccaagaagatagtagtcatatacgaagatcctttagatataatgtgtaggaccagcattaatttaatcaaccaagtctcctctcattgaattgttaattcataattacaaagatgacattacagtaaattaagaaatactgtaatttcattctctccaaaaagtatacattgaagtttggtgaatactgttatattttcaactagtaaatcagtgtgccaattctg

SEQ ID NO: 32813 - DNA, 87 bp, Homo sapiens
tttaatatagccagatccagtacaggattttcgcttgttacaagagctagggaaatgacagtggtatctaaatgtagcaaagttgtt

SEQ ID NO: 32814 - DNA, 1240 bp, Homo sapiens
  misc_feature (1240)..(1240): n is a, c, g, or t
tatagcttattttacaattgcctgaatcctcttttttatggctttctggggaaaaatttaaaaatattttctccagcttctaaaatatatcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgcaaaaaaaaaaaaaaaaaaaatttgggggggcgggccgaaaattttaaaacctgggggcggggccaggaagaaaggaagggcggaacggggaagggggtttccaaaaagggggccgggtgaacgagggtgggcgtaaggcgctan

SEQ ID NO: 32815 - DNA, 1015 bp, Homo sapiens
tatagcttattttacaattgcctgaatcctcttttttatggctttctggggaaaaatttaaaaatattttctccagcttctaaaatatatcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttccctcgtgccgaattcctgcagccgggcgcatccactagttct

SEQ ID NO: 32816 - DNA, 1186 bp, Homo sapiens
  misc_feature (1186)..(1186): n is a, c, g, or t
tatagcttattttacaattgcctgaatcctcttttttatggctttctggggaaaaatttaaaaatattttctccagcttctaaaatatatcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacacgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgcaaaaaaaaaaaaaaaaaaaatttgggggggcgggccgaaaattttaaaacctgggggcggggccaggaagaaaggaagggcggaacggggaagggggtttccaaaaagggggccgggtgaacgagggtgggcgtaaggcgctan

SEQ ID NO: 32817 - DNA, 240 bp, Homo sapiens
tattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgcaatgtatttatcttcattacttaaaatagatgctaatttatt

SEQ ID NO: 32818 - DNA, 344 bp, Homo sapiens
ttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtccc

SEQ ID NO: 32819 - DNA, 419 bp, Homo sapiens
tctgagatgcagtctcactctggcacccaggctggagtaaagcggcatgatcttggctcactgcaacctcgcctcctgggttcaagcgattctcctttctcagcctcccaagtagctgggattataggtgcgcaccaccacacctggctaattttgtgtttttggtagagatggagtttcaccatgttagccaggctagtcttgaactcctgacctcaagtgatctgcccgccttggcctcccaaagtgctgggattacaggtgtgagccactgcacccgtccagcaatggccctgctatgacctttcacagttataatatgcaatatttttattgacattcccagtccttaaagacctcagtgcatctccacctgggctcccttttccttgtattcacaaagtcatgacaacaaattg

SEQ ID NO: 32820 - DNA, 338 bp, Homo sapiens
acacagcacctttagaccaactcagtaacatcaaacccatatctaatgcccattccacaccaagcatgtgattggaaccttgtatactgtcttgctcaggttgtccgtggtctctcacctcatggagctcacagcctggctcataaagaaaaccccacatctgcatactcaatatcctgatccgtgtgaggggccttgcaggccattcctctcagacatttccaaagcaacaggaatcacagcagtgtccatgggtatggcaaggaagaccactggtctcatgaccactcttgggagtgggggaagtaaccccaatgcaaaggcttccctcaagatca

SEQ ID NO: 32821 - DNA, 790 bp, Homo sapiens
cttaatgattagtgacgttgaacatcttttcatgtacttcttggagattggtatatcttccttggagaaatgtctatttaagtcttttgcccatttttgaattgtgttgtttgtttctttgttgttgagttttacgagttctctatatattctgaatattaatctcttattatacatatgattttcagatatttcctcccattctgtgggttatcttttcacccctttgatagtgtctcttgatgcacaaatttaaaacattttaatgaaatcctgtttgtttcttcttttgttgcttttgcctttggtatcatatccaagaattcattgcagatccactatcatgaagcttttgtcgtatgttttattctaagaattttataattttaagtgttacatttaggtctttgatttattttgtgtatttgtatgtggtgttaggtaagagtccatctttactcttttgcctgtacataatccagttttcccagcaccatttgttgaaaagactgtcctttactcattgagtagtcttggcacccttgtaaaaaatcatttttccatacattgtttctgggccctctattctgttcccttggtctgtatctttatgtgagtaacacactattttgattactatagctttgtaatatgttttgaaatcaggaaatgtgagtacaccagcgtttttcttctttttcaagattattttggctgttcagggtcccttgagatttcatgttagttttaggacgtgtttttctatttctgcaaaaaaaaaaaaaaaaaa

SEQ ID NO: 32822 - DNA, 640 bp, Homo sapiens
acagaacaaaggtacttgggaacagaactggaatataaagatcttgtttcttcatatttcaaacaccaaatagtattagtctactactaatagtgttagaacaccagatacaaagctaaaatattcctaagtagacttgatcctcaagtgaaagaaatctaatgtctaagctacctaatgttttcctttctaacccacagcttgttacaataccagaaatattaaaaaaccttgtgtagataggagaactaaaatgaggaataggccgggcatggtggctcatgcctataatcccagaagtttagaaggccaaggcaggagcatctcttgagcccaggagttcaagactagcctgggcaacataatgagaccctgtctctacaaaaaaatcaaaaaaattaggcatggtggcatgtgcctgtagtcccaggtacttgcgaggctgaagtgggaggatcacttgagcccaggaggtagaggctgcagtgagccatgatcgtaccactgcactccagccagggtgacagagcgagaccctaactcaaaaagaagtaaaaaatgaaaaaaaataaaataaggaacaattactttatataagaaaaatttgcaactttcagatataagttggaaaaataagaga

SEQ ID NO: 32823 - DNA, 384 bp, Homo sapiens
tttttttcaactggacacaggctctcactctgtcactcacgctgtagtgcagtggtgtaatcatagctcactgcaccctcaaacacctgggctcaagtgatcagtcatcccaccacagcctcccaagtagctgggactagggagcacgtcaccacacccagctaatttttttttggtagagatgggattgcactacattgcccaggctggtctcaaactcctgggctcaagtgatcctcccaccttggcctcccaaagtgctgggattacaggtgtgagccactgagcctagtcaacataaggcattgataaataaaggatgtatgttacaatttctacaggtattgataatagtaaaagcttataactttcaaactaacaaga

SEQ ID NO: 32824 - DNA, 647 bp, Homo sapiens
ttgtgaggctgcatcaatgatgcatatttcccagtctcactgacttcttatggttaggtcagtatatgtgcgggggaaaagaaagagagatcagactgttacttgtggggaaaagagagatcagactgttactgtgtctatgtagaaaaaggaagacacaagaaactccattttgatctgtacttagaaaaattcttctgctttgagatgctgttaatctgtaaccttagccccaaccctgtgcttgcaaaaacatgtgctgtgttgactcaaggtttaatggatttagggctgtgcaggatgtgctttgttaaaaatgtgtttgcaggcagtatgcttggtaaaaggcatcgccatgctccattctcggttacccagggacacagtgcactgtggaaggccgcaggcacctctgcccaagaaagcccgggatattgtccaaggtttccccccactgagacagcctgagatatggccttgtgggaagggaaagaccttactgtcccccagcctgacacccgtaaagggtctgtgctgaggaggattagtgaaagaggaaggcctctttgcagttgagataagaggaaagcatctgtctcctgctcatccctgggaatggaatgtcttggtgtaaaacccgattgcac

SEQ ID NO: 32825 - DNA, 669 bp, Homo sapiens
tggggaaatcaggaagcctcttaaaggagaactaggccttcaccaaatggggaagtgggatagggttctaacagtatgcaactgcgctctgaaaggattacagagggactgccctgagaaaaggcttgctttcatgttgagcaaagttaaagcaagaggattgcattttaaatacttaaacaaaaagttaatttgttgttttcttttttttttttttttcatttcttctctctcattacttacttcttcagggcttggtaagtaccgttttaaggttaaatgtaatacgctgtagacttctagtttaagacgcagccttgcccctacaaatgatttgctggttttgctttttgtttttgagactcaagaaagacaaggaagaaccagtgtttgagaatacgttgacaagactttaccaccctgaagcatttttattagttgaaatgcagaaactactggtggccaacagttgaaaaaggagtcactagtcagcaaaacttacagatacttttttttaaaaacgttgttaccttcacatccccattatgtggcttttggttttttttcactggcctaggcacttgccttttactcttttgtttttggttttggttttttgagacagagcctgggcaacacagggagactccatctcaaaaattaaaaaaa

SEQ ID NO: 32826 - DNA, 351 bp, Homo sapiens
gcagaagagtcttgctctgtcgcccaggctggagtacgctggcaagatctcggctcactgcaagctccacctcctgggttcacgccatcctcctgcctcagcctcccgagtagctgggactacaggtgcccgccaccacggccggctaatttttttttttttgtatttttagtagagacaggatttcactgtgttagccaggatggtctcgatctcctgacctcgtgatctgcccgcctcggcctcccaaagtgctgggattacaggcgtgcgaccgcacccggcctaggggtgcaatcattcttatatttgctggagatgtagccagggctcaggagctgagcagagccc

SEQ ID NO: 32827 - DNA, 623 bp, Homo sapiens
gacacatgtggaggggaacaacacacactggggcctgtgtaaaagatatttaaaagcattttcagatgatacacctaggtatagttttttttgacatttatcctttttggtgttctttgagcttcttggatttatggtttggtgtctgacatttattctcagtcattattgtttcaaatatttcttctgttcttatctctttttcttcatcttctgatattcccattatgcgtatgttataccttttagagttgtaccacaatctttgggtattctgttctgtgtgtgtgtgtgtgtgtgtgtgttttatctttgttttctggttttggaggtttctattgatttacctcaagcttagagatctttcctcagctagtgttcaatctatgaataagctcatcaaaggcactcttcatttctgctattgtgtttttgatcactagcatttcttttggttccttcttaagatttccatgtctttgcttacattctccatctgttgttgcatggtgtctactttatccattagagcccttggcatattaatcatatttattttaagtttccagtttgataatttcaacatccctgccatatctggttctgatgcttgtgtatctctt

SEQ ID NO: 32828 - DNA, 2931 bp, Homo sapiens
  misc_feature (1316)..(1317): n is a, c, g, or t
  misc_feature (2416)..(2416): n is a, c, g, or t
acagagggcgggtcgcgcgctcggtggccgttgtgcgcgtgtgtggagtgccctgctgcccccagctggaggggaactagtctgctccaggtggcaagctgcgtgagcaagcaagccaacatggaccgcgactcgtaccatcactatttctacgactatgacggcggggaggatttctaccgctccacgacgcccagcgaggacatctggaagaaattcgagttggtgccgccgccctggacttgggtccgcagccgggaacccagccctcagctttggtctcctggaacgtggccggtagggtgcgctggggacgagacggaatcccaggactactggaaagcttgggacgcgaactacgcctccctcatccgccgtgactgcatgtggagcggcttctccacccaggagccgctggagagagcggtgagtgacctgcttgccgttggcgcgccctcgggatactcgcccaaggagttcgccacccccgactacactcccgagctcgaagccggcaacctagcgcccatcttcccctgtttgttgggcgagcccaagatccaggcctgctccaggtctgagagcccaagcgactccgagggtgaagaaatcgacgtgacagtaaagaagaggcagtctttgagtacgcggaagccagtcatcatcgcggtgcgtgcagaccttctggatccccgcatgaatctcttccacatctccatccaccagcaacagcacaactatgctgccccttttcctccagaaagctgcttccaagaaggggctccaaagaggatgcccccaaaagaggctctagagagagaagctccagggggaaaggatgataaggaagatgaagagattgtgagcctcccacctgtagaaagtgaggctgcccagtcctgccagcccaaacccatccattatgatactgagaattggaccaagaagaagtaccacagctacctggagcgcaagagacggaatgatcaacgttcgcggttcttggccctgagggacgaggtacccgccctggccagctgctctagggtttccaaagtaatgatcctagtcaaggccacggaatacttacatgaactggcggaagccgaggagaggatggctacggagaaaaggcagctcgaatgccagcgacggcaattgcagaaaagaattgagtacctcagtagctactgaccaaaaagcctgaccattctgtcttaaaaagacacaagttttctttttgatctccctctcccctttagtaacttgtacatttttgttacagcaggacactctggacagtagattgcagaatnnattgcagccagtgcacaaacaatataaaggcttgcattcttggaaactttgaaacccagctctctctcttccctgacttatgggagtgctttgtgttttctggcacctttggcttctcagcaggcagctgactgaggagacttggggtcttcctggctcactatctccaaagaaaaggctgacagatggtatgcaacaggtggtggatgttgttgggggctccagcctggaggaaatctcacactctacatgaactttaggctaggaaaggatgtctctggggtgatgcaaggacagctgggtgtggacgctctcctgcggctccatttttttccaggagacacacaagctgccttgggtgaaaacaagctcagagacttgatcaacgtggaccattacctcactgtcagacactacagtagctgaggagttggaaaccttacatatatgtatatatatatgtatgtatatatgtatatatgtatatatatatgtatgtatatatgtatatatgtatatatatatgtatgtatatatgtatatatgtatatatatatgtatgtatatatgtatatattatgatgttggctgacccccttcctcccactctcaatgctgtgactcagaacatttaagagaacttcgtctgtaagtaatttgtcttaaagccctctgggctctcttctctgagtgagggaactttctgtcttcacaagggactttgtctcattctgcctctgttatgcaatgggttctacagcaccctttcccgcaggttagaaatatttccctaagacacagggaaatgggtcttagcctggggcctggggaaagttcccaagccctggctcatgaactcaatccctgcccaggtgttttctgaggggcccttgaggccaatcttttctcaagacagtgtgaggcaccttagaagggagaactgtaacactttctctttcgcacctgcctctcatctcaatccttgactgatgaatttgaagttctactagaaccatgaaaacttgttcctttcgtgcatctccaaggagcttgctggctctgcagccacgcttgggccctcgcaccagcctgcaatgantcagatgtctgtcacagaatctgggcctctctgaagttttctggagagctgttgggactcatccagtgctccacaacgtggacttgcctcctggtgtgttttaaaggatcctccaggagctctgcttagccaatcatcatgatggatttttttttttttttttgagacggagtctcactcttgtcgcccaggctggaggttaatggcatgatctcggctcactgcaacctctgcctcccgggttcaagcgattctcctgcctgagccttccgagtagctgggatcgcaggcgcctgccaccacgcctagctaatttctgtatttttagtagagatggggtttcaccacattggccaggctggtcttgacctcctgacctaggtgatccactgcctccatgatagattttgccccagctggactctgcagctccacgtggaatccaggtgctgcctccagtctgggaaagtcaccaacccgcagttgtcatgtgggtaacttctgaaccctaagcc

SEQ ID NO: 32829 - DNA, 348 bp, Homo sapiens
ttgggttgtgttgatcccaggtttctggaaagcttgtccttagtcacttcaaaggattatagtttctactttttgacactcgaagaataatccgttcagcagggcgaagagaaaaccttgctgactacaatcagacaatgttgttaaaagtccttccaataagctgtctcatttaaagctacatgaaacctgaagaaaagggctgataaatttggaacatacggtctttccactgtgtccagcatgggtaacaatgatgccctagtaataccttaaattataaagggatttctccttaggaagatgtttagagctagtggtttccaccattagaatcacccagagagc

SEQ ID NO: 32830 - DNA, 837 bp, Homo sapiens
ataatatcacaggagtatactggataaatcatttgagaagaagctgggacatttgcacgtgttattccctttctggaactttctcccaccacacatctttgtcttgttgatgactttttgtcctttaggcctcaactgtcaacagggatggtctggctagtgctctctactgtaaattcttctagccttgtatagttcttcttagcactcattttatatttatttgagtaattcttcatcctgtgaactccataagataacgaagagttccgttattttttctggacattattgtatcatcactgcctaaagacaatgcttggcatggtgataaatatctgtgattgataaatatttgtttcatgaaggaacctgtgagtgaattgaatttggttggcgacaggaaggccagtacaaagattcctgcctgcagcctcaagtccgaatgctgaaggggccgggtagctaaggtaaatgggtgaagcagactgtgaggaacatgagttgctctgggcaaccagatagaatgttctggacaggtgctcgcttggtggatgttctcttgttccttccgtggaggcggattcttcttactcagggatgtaggcttgaaccgtggtaaatatcaaggactccctgggaagaaaggacttatggagtagagaagactgaggaaacttacactactcttcattgaagtctttctggaatccacagcaatggtgactgaaagaggaaatcaggaggtaaagttagcctgcagtgggttgaggactgagtgggaagtgagaagggaaagccagtgaagggaggctcctcctttgagaggtttgtcta

SEQ ID NO: 32831 - DNA, 468 bp, Homo sapiens
tggcagttctctcttgcaggccactgtgagctggctccagtataccactgctcttagtcttcacctgtttccaaaaacattgtttgggggcgggtttcgtgaggaggcttaaagagccatgagaaagggaggacccagcagtgactccctggctaggggtggggctttgtgttgggcatcagggccctaatgccctgtttacccagtggcccgccagcctgatcctcacagccaaggagcatcctgacctacagtacagcatcagtgtgagcttttgtgtatttgaagatcttccttggttcaggcgctttctgcaagtcactcgaacaccgcttcatctgaccacacccgctcccaatttaaagaagatcgttgatacactgttagccctataactctggcctttttcttttaaaccactctctacaagagatgattatcacttgcatgtgagtttctgcatttctg

SEQ ID NO: 32832 - DNA, 353 bp, Homo sapiens
gagagggcattatttcaggtaaatatcacaaagcccacccttttaaaaactattccttagtactttgcatttattttcaaaataagtaatacacgaatgtggtataaaattcaaatggtgcaaaggatatataaggaaaaactaagtctttcttagtttttctgttcacctcccagtcacctagttcccctcccaggaggcaaccactgttgtagatataaatcatgtataaatagatcctatatatgtatttatatatgtgtatgcatgtattttaaatacaaatgatagcatacgtaatacatatttgattatggccttgcagacttctgtaccaaaacataaaggtctgt

SEQ ID NO: 32833 - DNA, 438 bp, Homo sapiens
tattcttcatgtattttttatctcgactaatgacactatcattcacctagttgtccacttttagctataatttattgaggtataatttatatacagtaaactgtcatttgaagtatataattagatcagttttgacctatatccacctgtgaaaccaccaccacagtcaagatataaaagatttccgtcatccccagaagttttctcatgccactttgcaatgtttatcctctatctacccttgacctagggaaccaagttcattatctacctttagtcactagagattcgtttgcatttctataattttgtataaattgcataatttatataaatttcatataaatacaaaatgttgtattagggttctccagaaaaagagaaccaataagatagcctatctatgtctatacataggcatagatatatatctataaa

SEQ ID NO: 32834 - DNA, 597 bp, Homo sapiens
aggaaaaaattgctttattataaaaagggctttgtgttagataattttgccgaactgtaggcaaatgttttctgagaacgtttaaggtaaactaggctaagccatgatgttcggtaggttagatggattaaatgtatttttgactcatcatttttataactcatggtgcatttattgggatgtaaccccgtcataaactgaggagtatttgtatttagaaatagagctgagtttgacagccaactttgtctgttaggcagtgggtgccaggccagtggtgctgggatttccagtgtcccctgcctccagcagtggacccagctgagcctctgggatgctctgcccctggcaccgaaggctgcttggtgccacaggagaatctgataggagacatccagggctgctgaagtggctggggtgtcagaggcgtttgaattagagcaactccatcttgaataaggactaggtaaaataaggctaagacctactgggctgccttcccagacagttaaggcattctaagtcacagggtgagacaggaggtcggcacaaggtccaggtcataaagaccttgctgataaaacaggttgcagtaaa

SEQ ID NO: 32835 - DNA, 963 bp, Homo sapiens
ttgacttccattcctatttctttctctgattgggaccgaggtttgtccctgttctgcttctgttcatcaccactcttgcttttgtttgtcttctgttcgtcatcagtcttgcctttgttctggctcagagacctctgtccccattccttccccgtccccctcaccagggtaggcctcgggctcccctcctgcctggacaccacagtagggagggcccaggatcctgccttgtcgcccacccagcatgcagcagactaggcttgtctcctgctgtgctgggaagtccttctgctcttggaatcctcccaccccacagagtgtgctctgctggccatattagcctataagctgcacctgcttgccttcccacacagtccactgcagctatgttggtttattctctgctttcccaacttcagatttttgtttataaccgtctgtgccctggtgtgacttcactattttagaaagcagccccctcccgacattacaaataccctcctcttgttccaggtcctccccattctgaccaccctgctgctggaaaaccatgtgtgtcctctggcaggttaaatgcagacagcaatccagtgatataagtttttttaggttcactagatcatatgtcggcttatccctctcaataaatatcagtgccttactcatgcaccagtaattatctgtatagttaatttggcaattcatcatgtactgctttatggcatttattctactcttacattaaatggttaattcttaattttgaagaagttaaatgtcttacaaattgactgaaagcccaaatttgcccttatatttcttcattagggccttaagaattattgaaaatacagaaataagttctagtgtttgatagcatagtagggtgcctatagtaaacagtaatttgttgtgtaattcaaagtaactagaagagaagatttgaaatattcccaacacaaa

SEQ ID NO: 32836 - DNA, 261 bp, Homo sapiens
gctctgcctccactcactcgaagcccctctgcctgcctttagaacctcatagcttccctggcaggccccacaaggagccccagtcttctctgtgcctgcgctccatccaatcccaactcaccatgtttttgtttttgttttgttttgtttgagacggagtctcactcactctgttgcccaggctgaagtgcagtggcacaatctcagctcactgcaacctccacctcccgggttcaagcgattctcctgcctcagcctccc

SEQ ID NO: 32837 - DNA, 585 bp, Homo sapiens
tcctggcttctgcgtccctggaggctccgttcccgtttcgccagctattttgctgcctcggccatctgttccctccctgtcatctcctctcgacatccttcacgacgcctggccctccttctcatctccagcaagtgaaccgctctgtcctttttaaagcctcatcccaaagacacggccagagcttggagttggattcgccccacacaactccccctctttgatgccatctgctttcaactccaccactggccaggggcaaacacctaccccttcccctgccttttcctcctgagacttcttctcaaactcggccaagaagctctcctggcatggacagcgtgtctgctccgggtctctacctggtctccatcaacagagccatgtaaccgcccagagggctccaggtccgcaagctgaggcggaggccagaaactctgaagttcactcctactgtggaggaacgagggctcgtgctgggagtttgggtcatgaacagtttccctgtagaaaatggacctgaacactctgcagtaaggaattgtttcccatgctggcatggtgggaaccgaaccaaaacacatt

SEQ ID NO: 32838 - DNA, 501 bp, Homo sapiens
gaaaaaatgctttccgagacaggcccatggaaggcccaactcaccctctgggacttattcaacttggattcatctgtctgcttttgcctctattttaaccaaaagaccccatgaaggtagggtcttggtatggcctcttcacgactctggacctcagcacacatcaagggcctggcacacagtaggtgctcaataaggacttactgaatggaagccgggtgtggtcgtcacgcctgtcatcccagcactttgggaggccgaggcaagtggatcacgtgaggtcaggagttcaagaccaacctggccaacatggtgaaaccccgtctctaccaaaaatacaaaaattagccggacgtggtggcaggtgcctctagtcccagctacttgggaggctgaggcagatgaattgctcaagcctgggagacgggagatggaggttgcagtgagccgagatcatgccactgtactccagccttggcaacagagtgagactccatctca

SEQ ID NO: 32839 - DNA, 788 bp, Homo sapiens
tagggagccagcccaggagcccagctgctgcagtcagatgctcccaaggacagcagcctgctccttgccatccaccacaaaccctcaccgaaccagtggccaccaccatgacaagggaccagaatggaacctgggagatggagagtaatgaaaactttgagggctacatgaaggccctggatattgattttgccacccgcaagattgcagtacgtctcactcagacgaaggttattgatcaagatggtgataacttcaagacaaaaaccactagcacattccgcaactatgatgtggatttcactgttggagtagagtttgacgagtacacaaagagcctggataaccggcatgttaaggcactggtcacctgggaaggtgatgtccttgtgtgtgtgcaaaagggggagaaggagaaccgcggctggaagcagtggattgagggggacaagctgtacctggagctgacctgtggtgaccaggtgtgccgtcaagtgttcaaaaagaaatgatggcgacgtgggaggcctgccaagcacaagctccccactgcccacactgagtggtctactggctttgagaaacagctgtggggaccttcccactcttgacagagccccattaaggcatctgggtgggttttaaacagaatgcctatgtagcagtgatagacatattcccctcctttgaaacctagcattaaatggaaaaacaaaaattagaagatatagcacgtagagattgttcaataaggaagaaaaaaataaaaattggccttgttggcctca

SEQ ID NO: 32840 - DNA, 747 bp, Homo sapiens
tagggagccagcccaggagcccagctgctgcagtcagatgctcccaaggacagcagcctgctccttgccatccaccacaaaccctcaccgaaccagtggccaccaccatgacaagggaccagaatggaacctgggagatggagagtaatgaaaactttgagggctacatgaaggccctggatattgattttgccacccgcaagattgcagtacgtctcactcagacgaaggttattgatcaagatggtgataacttcaagacaaaaaccactagcacattccgcaactatgatgtggatttcactgttggagtagagtttgacgagtacacaaagagcctggataaccggcatgttaaggcactggtcacctgggaaggtgatgtccttgtgtgtgtgcaaaagggggagaaggagaaccgcggctggaagcagtggattgagggggacaagctgtacctggagctgacctgtggtgaccaggtgtgccgtcaagtgttcaaaaagaaatgatggcgacgtgggaggcctgccaagcacaagctccccactgcccacactgagtggtctactggctttgagaaacagctgtggggaccttcccactcttgacagagccccattaaggcatctgggtgggttttaaacagaatgcctatgtagcagtgatagacatattcccctcctttgaaacctagcattaaatggaaaaacaaaaattactcccatattttgaaaccctttatat

SEQ ID NO: 32841 - DNA, 432 bp, Homo sapiens
aattgagatggagtctcgctctgtcacccatgctggagtgtgctgaggtgtgatcttggcttactgcaacctccgcttcctgggttcaagcgattctcctgcctcagcctcctgaggtctcattgtttatattacatttttgccttgactcttctttgtgaggtaattttctctaatatgaatataggttgggaatgagatcccacaaaactctctcagcacagcaacatatctctgccttctcatcccctgcacccagagagctcagggctgcagaggtaatcaaatgggaactgaaaacgggcttgcaattatacatactgtaggggccaaacctgcttctcaggaaaaacatgtcccccaccccaaataaccaaaaaactcagccatgttgttaattatccaacttgggttttctgtttcattccagga

SEQ ID NO: 32842 - DNA, 427 bp, Homo sapiens
ttgaaaagtgaggaaatcagagcttagaagtgtagtctctctaggctttaagagaagacatcaagattctgaataattaacaaaactggtaagggcagcttaatagatggcacatgtcctgcactcccatgcaaaggtcccagggagcttaggggaaagagggctggatggtctggaccttggatctgaccacatttgtcctcatggccagatgggccacgtggtccaagtaacaaggatgtctatggggagtcctgcgaggaacccaggcagcttctcctgcagacccaggacaagcatggccaagccattccccgtggtcggcgacagctgttggaggaaggagggaggaagaagcgctcattcagatgatgggtgaggagagaatgccagtactggcagaaggggagggaagaatggaattctc

SEQ ID NO: 32843 - DNA, 302 bp, Homo sapiens
gttcatgtgttagttctgtgggcataagctgtgcagtcctcatttacaactcataaaagctacagtgacaggtgctgtagaaaggggatgatagattagctgttgctcatgcgagcaatgaagcagcaagagagagcacattagaccaagcgagcagccagaaacagcaataaaatcattactaaaagagatgatacggttaacatgggaatatatatctttctggcactggcattgtatttactggtgtactacacattcaaatagattgttcaaaagattcatttctggattgagataag

SEQ ID NO: 32844 - DNA, 513 bp, Homo sapiens
cgtcactgctctgggctctgatgagcatgggacggaggcaaagggggagttgatggtgcctcagcacaggcctgcaggtaccccttgttaggaacagcttgggcactggggatgacaggttgatggcagtgagaggcagaaaggctcctgggcttaaagggacaggtccctgccaagccccaccttcaggcctaggactgatggcctgaaacctagggggtcaggctgccagttccctggaccagagtgagaacttaatggggctttttctaggcctgtccatggccagctatggaccaataagcacccacttcctgccctctgaagctcacaaaaagcccagagttagccaaactttggcagacatcccaacaatctgcctgcagggaggagctaggcactgtgggtctcctctcagctgagagctgagcagacatagggatgacctgcctgtggaaaggctcctgagagctgtactgtcactcaataaaacatctctttgtctcacttacc

SEQ ID NO: 32845 - DNA, 532 bp, Homo sapiens
atatagtatcatgaagttatatctttaaactcttagtttgtactatgtggtgtcttatgaaaaccttgatttgtttatacttagtgaatgaaacacttgggtttaaagttctttaactgatgtcacttcttaggctagaaagctgttgaaagaacttagtgttccacccttagaccaaggttcatgtcaccatatttaacagcagctttgtattacggtcaagattgtttgaagaattcagcatacaaacttaatttacagatgcaagcctgcagatggacctccccccccccacttttttgctttagattaggttgtgactggaggaaatttagttttcctttgccttcagttatttgcagctgttcacatttatgatgatgagaatgatgatgatgataatgtatttaggattcagtgtgaggagaaaaaataaactagtttttctttcttccttatcagtttattcccattatcttattttcccttctctgtctctgccttcctttcctcctcgggaaaaaaaagaaaa

SEQ ID NO: 32846 - DNA, 733 bp, Homo sapiens
agtaagtgttagcttttttaaaatgcaagttattcttctgatagaataatcttgcagggagctcaaggccatttattattaagttccttcattcctatttagcttaaagtctgtttcttgatgatatgtagtgaaatggtaagtatgataacagatgaaatagtaaaaaaaatcatcgaattatcagctctaatagcctcattttgcagatgacaatatgaaagtccataaaggttaactaatttacccaaggttgaacgatgagtttgtgcatgagaactcaggtttcctaactcctgggtcaatatttttccattatattcctttattcaatgtgtatacttcagaaacccaggttatttaatgtatataataaatagtaaatatatatatataatcaagtttctgttacttaagtacataattgtcatttatattcgctgactctccttggtggttttaaaaacctgtgtcccaaaagcctctgtacagtgtgcatgatactatggaaagaagatttacaatttagtgcagagtctgtactttaaaaagaaaccattctcgagttgggtgcagtggcttgtacctacctataatcccagctacttggaagactaaggtaggaggattacatgagcccaggagttagtggctgcagtgagctgtgattgtgccactgtattccagcctaggcagcagagtgagacaccatctttgaaaaaattaattagtt

SEQ ID NO: 32847 - DNA, 329 bp, Homo sapiens
gcctcccgaagtgctgggattacaggcatgagccagtgcgcctggccacatttatttttaaaatgcatttaattgttgtaggtaattttaatttgactttatatgtttcttatttcagaagtttctccagtgcaaatatgtagcaatcatggtataatatacattccctgctccccaaaccccccacaattttgaatgcatatctgaattgcttttgttatttttgtttgtatatgataatcttttatgtggttctgaatcataaggacttttctgtcctagtccacttttgcaattatttattatcatgacctgtccaccataatttg

SEQ ID NO: 32848 - DNA, 251 bp, Homo sapiens
catttaatcgtgtcagtgcttttatcattgtattttgttttatctctttggaaatagacactttgttgtagaattttgcttgagaaagaattcaccgcttaaggtttttacttttcaacacaagaacctgtactgctttcagatttattacattttcttggaaacaccacttccccagcagtaaatctatctttgaattatgactcccaaaaataatcttcacagaaaaggaatttgagaataatagctga

SEQ ID NO: 32849 - DNA, 355 bp, Homo sapiens
aaatgaattttaaacatttcttggttataatttttaatgtggtaaatactgatagcgataaactacatagataaaagctttctagggtcctccataatttttaagagtataaaggggccaagtgtggtggctaacacctgtaatcccaacactttgggaggccaatgcaggaagatccaacatagcaagaccctatctctacaaaaaaatttaaaaattagccagacgtgatggtgtgtgcctgtagtcctagttacttgggaggctgaggtgagaggatcacttgagcccagagtttgagattgtggggagctgtggtcatgcactacattcctgcctgggctacagagtgaga

SEQ ID NO: 32850 - DNA, 311 bp, Homo sapiens
ggatgtacaggaagaaaatgtttctctctgataggccttccaggaatgcacatctgaatctaattatgagaaaacactgggaacctaaattaaaggccatttgacaaaataaccagcctataatcttcaagaatgtcaagtcatgaaagtcaaggaaagaccaagaaactgttccagactgaaggacactaaagaggcatgacaactaaatataccatgggattctgaactggatccttttactataaaggatattgaaacaactggtgaaatatgaagtggggtctgcagatcagataacagcaatttca

SEQ ID NO: 32851 - DNA, 404 bp, Homo sapiens
aaaaaaaatcagtattgctaggagtttatcaattttattgaccttctaaaagaatcagcttttggtttcacagattttctctactgtttgtctttttatttccttcctcttctttttctaacacctttggatggaagatcactgattaaaggctatacatttccctctaagcactgatgtaaacttccataaactttgatgatgcattttccttttcaatcagttaaactattttactaatcacttgtgacttcttctttattcaatggtttatttagaagaatattgatggagctgggcacggtggctcatgcctgtaatcccagcactttgggaggctgaggcatgcaaatcacttgaggtcaggagttcaagaccagcctgaccaacatggtgaaaccccc

SEQ ID NO: 32852 - DNA, 520 bp, Homo sapiens
gcttgtgttattttctaaggttcagataatcaatataaagaagaagctggtagctatgctttgacaaacatgaattatgcaatttttattttttgaaatgaattttagttgtaacaataaattttgaataggactattttataggccaactgataaaaataatttcttggccaacaaatatttccaaaacatataatttttatttttatccccatttagcctcaaaatagccccaatttagatgaaaaattacctggtcactcaatttatgcaccaattttcaatgtgtctttatttttgcatttaaacaatgttttggatcatgccaaagttctctatttaactaaaaaatttatcttaaaaacgtattaagttttagaaaatccatagacctccttgtaagccccaggtgttaataatttctgtggttgaaggagatagcaagaggttaagattagcagcagcttattttcctatgagaacccggtgtgtaaagatgaaaggcaacatcattcaaatg

SEQ ID NO: 32853 - DNA, 373 bp, Homo sapiens
gtgggcagatcacaaggtcaggagatcgagaccatcctggctaacacgatgaaaccccatctatactaaaaatacaaaaaattagccaggcgtggtagcgggcacctgtagtcccagctactcgggaggctgaggcaggagaatggcgtgaacctgggaggcggagcttgcagtgagccgagatcacaccactgcactccagcctgggtgacagagtgagactctgtctgaaaaaaaaaaaaaaaagaaaatacaggggaaaaaatggcaacacattcctgtcacccagagatcaccactatttactctttattatttgtttttttttttttgagacagcctgggtgacagagtgagactctgtctgaaaaaa

SEQ ID NO: 32854 - DNA, 443 bp, Homo sapiens
aataagggcttttgacctggaaactgctccttcttgggggaacttggaggtggtcttgcacttggggaggctgggcctgccgccaaggtcttagctaaggttaaagaggacactacctcaactgaaaagctctgcagtgggtcattcctagccaggtaaaatggacttatcttccatggtgcgctgccacaccacccccttcacaggaaggactggtcgcctctatgttctgaaagcatgcaactccttttggagagttcttccatcttggaggaagggcccatattgattatcttcgtgtctccagtggccagcacagtggctggcatgggtcattatgcatggaaatatgtcgggttgcaatgaattgaatagttttgacattgttatgtcaactgacattgaatggtgccctctcagtcgacgtgatggggaaactgagg

SEQ ID NO: 32855 - DNA, 443 bp, Homo sapiens
gcatttctcagaacttattcttgtctgttaagcaacatgtgactgtgttttattcttatttttaaattttacatcatcttttcaaggaaacctctggaaaaaaaaattataccaaaattttcactgcccactcaaagtggtctatttttactgtttatcttacaactgaagagactatccatgccttgctaaattctactttagctgctgagtctgtctatatacttaataaatttactgtcattcaaattacataataaacataggagcttacaattacttttctaggataaaatctatgcaggaagtttgtctcaagagaggaatttttgctgggtggcacatgtctgtaatcccagcactttgggaggctgagatgggaggctcacttgagcccaggtgttcaagatcagcctaggcaacattgtgagactccatatcta

SEQ ID NO: 32856 - DNA, 946 bp, Homo sapiens
gccttgtttctgatcttagtgagaaaccttctaatttctcaccattaagtattgtgttaagttttagagtttttcgtactctttatgaagttgaggaagttcctctctattcctagtttactgagagcacccattaattttaaggagttagattcttatttgacagaaaaacaggagtatattgaatcagaagcagatctgtgaagttaccttgcttctttgtaccaagtcaaaccatttcttttttatatatatgctacagattgtaaggagaaatagcctcattttaatgatatatatgaaagctcctgctttaggtttgtctgtgctctagtttgctgacccaaattaactttgttttatatacacctaagtacatacactatttaaatcttgtgtctaacataaattgaataaatttgctttgtctgctttcttatctaagtgaagctatagaaaacttgatctcaaaccacatataattcagttgtacacattaatggtacaccataaatggtagatctcaaaagtaatgatttcaatttttaaaataatttttttcaaatgcgcatatctgatatttcagagaatcacttcgtacaaagtgatggaagcccagtatgaagacctgagtttggaagaatcatgaagttgtttgagcttctgctttgtccttttgcctgtctttccctcattcctgccagcaatggatagtgtcttttctcagattgatgcagatttgccagagatgagatgatctttctttaggttttctggctttctgatcttcccttcctagaaattagagaagctaagtatttggcttcaagtactttcctttctaggcctgagaatatacgtatgttcataattaacaaacccaaggcaagaactgtccagagaaagaacatgagtggaatataaatgcttatatgtatgggttccc

SEQ ID NO: 32857 - DNA, 2533 bp, Homo sapiens
ctttaccctacatgcctgagaagccaggggccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctccctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccggtgagggaatctgcactccccgctctcctgccccccagccccagcaccctctgcagccctcgcacttgtcagcatctgtcaactcatatccgggccccaaagcttctgcagggcagaagtcaaagactcttaaagatccttacatggaacacttctgttttataattagggaaactgaagcccaagggttataaataagtttgctccaaatgacacatctcacattacaaattgatgacggagtcagggcttgggtactgatcttaatcaatagattgaattctttcactggtattaactgagcacctaggggccaaacgctatggtaggcatttcacacatatgatttcatttactcttcacaaccaaccctgtggagcaggcactattattaacttcatttgacatatgaggaaatggagctttacagagagataattacctgaggccacaagtaataggtggtagctctgggattggaaccaggtcgatctgattcccaagcaatgtctccccacctggctctagactggcaaattgcttaccctgcagtcgagaacttaagctgagtacacattcaaacaactaattgctacaacgttgttgctaaggaccaaaggaggctacacaaaggaaatgctgcagaggttctcagaagatcactgtggacaggggacgtcaaagaagacttcattcattcattcattcattcattcactcatcattcatccattcactcatttgttcacttatcaaatactatatggccagccctatagtacagttgcaaatagaaataaaatacaccaagacgaccagtagaggccaattatacgatgttttcggggagcagggagctatggtggcataggcgggagcaactaatcatcctggcaggctaggggaagctcagcagaggaaggatagccaaggtgggtcccgaaaagattggagaagacaggtaatgggggctcagggaggaccctgaagaatggagccagagccctctggcataagcatctgtaaaggtgggagagggaggaggagtaccgggatttctggaagcctcggaggactctctggttagtccagccattctcgtgctctgagcctgtgagctggtgtttcctcgcacattaattatggaggcggtgtctatca

SEQ ID NO: 32858 - DNA, 2364 bp, Homo sapiens
  misc_feature (1831)..(1831): n is a, c, g, or t
  misc_feature (2097)..(2097): n is a, c, g, or t
  misc_feature (2322)..(2322): n is a, c, g, or t
  misc_feature (2363)..(2364): n is a, c, g, or t
ctttaccctacatgcctgagaagccaggggccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctccctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggaggtaagatccctgcagcaggacactgcacccagcaggctgggaacttcctcaggtggggaccctggaggagcacccaggntgtaggcagaggtcccctcagcgtccccatattcggggggtgttctggacagggtcaaatgtgatgcctggggtcaatcccagctgtctgtgtttctttccctgcttttcttccctcagaacagagctcagcgggttgaaaaagggtggacctacaggccaggcaggcagttgctgggcagatgttctcccagaagtatttttttgtgtaaggttgcaatggactttgaaaacgtttcagtttctgcagaggattttgtgatagtntttgttatcaagcatttatgcatgggaatccgctcttcatggcctttcccagctctgtttgttttagtctttttgattttctttttgttgttgttgttgtctttttttaaaaacacaagtgactccattttaactctgacaactttcacagctgtcaccagaatgctccctgagaactaccattctttccctttcccacttaaaatatttcatcagaacctcacnactatcataaaagagtataaagtaataaaataataaaaagnn

SEQ ID NO: 32859 - DNA, 2368 bp, Homo sapiens
ctttaccctacatgcctgagaagccaggggccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctccctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccggtgagggaatctgcactccccgctctcctgccccccagccccagcaccctctgcagccctcgcacttgtcagcatctgtcaactcatatccgggccccaaagcttctgcagggcagaagtcaaagactcttaaagatccttacatggaacacttctgttttataattagggaaactgaagcccaagggttataaataagtttgctccaaatgacacatctcacattacaaattgatgacggagtcagggcttgggtactgatcttaatcaatagattgaattctttcactggtattaactgagcacctaggggccaaacgctatggtaggcatttcacacatatgatttcatttactcttcacaaccaaccctgtggagcaggcactattattaacttcatttgacatatgaggaaatggagctttacagagagataattacctgaggccacaagtaataggtggtagctctgggattggaaccaggtcgatctgattcccaagcaatgtctccccacctggctctagactggcaaattgcttaccctgcagtcgagaacttaagctgagtacacattcaaacaactaattgctacaacgttgttgctaaggaccaaaggaggctacacaaaggaaatgctgcagaggttctcagaagatcactgtggacaggggacgtcaaagaagacttcattcattcattcattcattcattcactcatcattcatccattcactcatttgttcacttatcaaatactatatggccagccctatagtacagttgcaaatagaaataaaatacaccaagacgaccagtagaggccaattatacgatgttttcggggagcagggagctatggtggcataggcgggagcaactaatcatcctggcaggctaggggaagctcagcagaggaaggatagccaaggtgggtcccgaaaagattggagaagacaggtaatgggggctcagggaggaccctgaagaatggagccagagccctctggcataagcatctgtaaaggtgggagagggaggaggagtaccgggatttctggaagcctcggaggactctctggttagtccagccattctcgtgctctgagcctgtgagctggtgtttcctcgcacattaattatggaggcggtgtctatca

SEQ ID NO: 32860 - DNA, 632 bp, Homo sapiens
tttcattggatggaatgaggccttagaggggacccatcttggaccggatgaggacaacagtccagaaatgctggaagaccaagctgcatctttggcagattatattttccaaagatagaggcaacactatatcccattccacgagcacttcttctgctgtgactttgacacccctcccattgaggggtggcatctatgtcccctcctcatgagctgcagcaggaggagctttgtgactctcttgaccaatagagtatgccagcattgacagcgtgtggcttccaaggctagttcaaaaaaatgcctttcacttccaccttattctcctgggatgttcactcttggaacccagccaccatgctgcacggaagcacaagagtccttggaaaggcctacatggatgggaaccatggcccccagcccaaataccctgctgagctccccagctgacagcaccaacttgccagccacatgagtgagctgtcctggaagtgattctccagccttggggcgagccacctcagctgatgccatgtgaagcagagacaaattacctccaccaggccctgcccaaattgcagatctgtgagcaaaacaaatgactgtgactgttataagcagaaaaaaaaaaa

SEQ ID NO: 32861 - DNA, 421 bp, Homo sapiens
gaaacccatgttcttagagagtcgtctggctactgcgtagtcctggaatattctttttttcaaaaggcctcttccagttgattccaaccgggttcgggttattgttctcaccaccgatagggggcagcaggtgtcctgcgatgccccggggatgtgcgcgcagactgccctgctgtccccgggaatccgactacactgaacgtttggggcagaagcaggagctgctgcctctaagtccaccgcagcagctgccgggacttgggcctcccagcctgggcgcctggggggggcttgccctgtgcaaagggtgggcgaaaccatctgtgcaccaagcctgcccctaaacttagcgtacagcatagataaataaactcagttgtatgcaaatgctataattaaaatatacagtcatttgaaagta

SEQ ID NO: 32862 - DNA, 450 bp, Homo sapiens
gcaggcacttgaccagcactgtcttcttgaatccccattctagctctgaaggttaggttttattttccctatttacctgagaagaaacctgagaatcagaaaggttcagtaacttggccaagatcacacagcttttgagtgactcttaaccacctggaaagcgttggggagatagaggcactttgccgaggcaagtagctgtttaaaaaggagggtggctctgtccagcccttctgaggagcccaggagccctgcgggggggggccacgtggacaggcaggaatgtgtcatcccgtccctgagtgggcttctcagtgactgtagccagcagtcctgcttctccaagggcctgagctgggcctctgctgccatgtgccagccattcccagggcaggaggccgtgcagtggatacacgcattgcaacacgaattccctctcatgcctgcttc

SEQ ID NO: 32863 - DNA, 388 bp, Homo sapiens
gtgataacatcatacacatcatgaatcgtatatacaatggtggtcagctacattataattttatgggaccaccattgtatatatgattcatcacttactgaaacaatgttatgtgatgcatgactatatatgtgaagtggcatgttgtttgacagttaacttttgacataattagtgacatcatagccattttaacatcatagcacaatgcattactcacatatttgtgatgatggtggtggaaacaaacctactgcactgctagttataaaaagtatagcaaatacaattatgtacagtatacaatacttgataataaatgactgtgttactgatttatgtgtttattatacttttgactgttattttagagtatactttttctaat

SEQ ID NO: 32864 - DNA, 614 bp, Homo sapiens
aaaggaggaactggcgtatcacatggctagaggagcaagagagaaatagaggaagtcccagatcatttttaagaatcagatctcacattaactcatggagcaagaactcgtcatctcaacgagggcaccaagccatttatgagggatccagatatccatccccataacccgaacacctcccaccagccctcacctccaacactggggatcacatttcaacatgatatttgcaggggacaaatatccaaaccatatttctccatatcttggtcagtgctggtgttaacagtttttgtttttaattttgccaatctggtggatgtgcaattgtatctcattgaagtgtcactctgcatttctctattacctgtgaagttgagtattttttcataagtttattggccaatttgactttctgtttttgtaaagtatcttgtcaggactgccacacatgtttttgttgtgttgctaatctttttcctcattgattcataaaggatctttataaatcttattctttgttggctgtatagttgccaatatcttctcccaatttgtggcttgcctttccctcccttatgatgttctttgataaaaacaatttattaatggtt

SEQ ID NO: 32865 - DNA, 359 bp, Homo sapiens
ggatatgcaaggtaaaggcatcacggtattcttgagacagccaatgaattttctgaagatttttgagcattcagtatagtaagaattttaatgatcttcagctcctcttagatctagacacaaatatggaaatgtatattgtgcaatgcaaatgaactggaaatgggtttagtggaaggtactgccatccctgggatggttgcattaatacccagaaccaaaaactgctcaaaaggtaacactcttccatcagcaaaagagaacaggcaaactgctctaacaaaataataaactatgtgtccaaacaggggaagtaaatacttttacataacacaaaagagaatggagctagggagaaa

SEQ ID NO: 32866 - DNA, 408 bp, Homo sapiens
tttattgctggaaatttctttatttccaagtgataggtatttgtaaactcaaaagccaaattttgtctgaaaagtcagatatcaagaaagtgtgcagccataaaaaggcatgagatcatgtcctttgcagggatacggatgaagctagaagccatcattctcagcaaactaacacaggaacagaaaaccaaacaccgcatgttctcactcataagtgggagttgaacaatgagaacacatggacacagggaggggaacaacacacaccagggcctgttggggggtaggggggcgcgaaaggagggaacttagagagcgggtcaataggtgcacaaaccaccatggcacatgtatacctgtgtaacaaacctgcacgttctgcacatgtatcccagaacttaaaataat

SEQ ID NO: 32867 - DNA, 842 bp, Homo sapiens
ctggggctgccatgtgtcagacagtggtgatgtgatggggggacacaggtcagtggcagggtactgggagtttcccctttcctttctcagttctttgcacccattttccatgggctgcctccccagatccagaagccccagcagcccctcaccccagcagtggaaaaagcccgtcattgacacggctgtgggtggccggctttgcaaaagcctcacatttggggctttggagggctttttgcatttcatctttacacaggctcctgcacctcattcctcttgccctcctctcagctttcctcccacttccagttagagagatggcagctctggcaggaccaaatattgatgtttatcacagttttagggccatttgtctcaccatctgaagggctcagcgcaggcccacgggatcctctctccttgagtgacctctgggggcaggtatctggtttggatgctggagctggtccctactcttcccttgggggccgtgcggccgggtgctcaagtgttttaacctcaggaccctgattagttatcatgaagctaccccaccagctcctgggtctgttcatggattagtggcataaaggacgtaatattgttttgcaaaatctgctctccctcccatgtctcctgcccaagaagttggtcttcgtggggccaaaggcaaggaggacccgaggaaggaagaggaaccactgtccccagcccctggtatggcatggcgtcagcctagtgaccagaaattgcttttgaactctgaggcttccagaggacaagaggaagaggaggacagggctgccctgcccactgctcagccttgagccctgcacctg

SEQ ID NO: 32868 - DNA, 886 bp, Homo sapiens
  misc_feature (498)..(498): n is a, c, g, or t
ctggggctgccatgtgtcagacagtggtgatgtgatggggggacacaggtcagtggcagggtactgggagtttcccctttcctttctcagttctttgcacccattttccatgggctgcctccccagatccagaagccccagcagcccctcaccccagcagtggaaaaagcccgtcattgacacggctgtgggtggccggctttgcaaaagcctcacatttggggctttggagggctttttgcatttcatctttacacaggctcctgcacctcattcctcttgccctcctctcagctttcctcccacttccagttagagagatggcagctctggcaggaccaaatattgatgtttatcacagttttagggccatttgtctcaccatctgaagggctcagcgcaggcccacgggatcctctctccttgagtgacctctgggggcaggtatctggtttgtaggcaatcggctggggaggcatggagttcccataacgtacntttgcgcacgtttggggggggacccagtttggccagggccccgaggggtgtctcaaggtgttttaacctcaggaccctgattagttatcatgaagctaccccaccagctcctgggtctgttcatggattagtggcataaaggacgtaatattgttttgcaaaatctgctctccctcccatgtctcctgcccaagaagttggtcttcgtggggccaaaggcaaggaggacccgaggaaggaagaggaaccactgtccccagcccctggtatggcatggcgtcagcctagtgaccagaaattgcttttgaactctgaggcttccagaggacaagaggaagaggaggacagggctgccctgcccactgctcagccttgagccctgcacctg

SEQ ID NO: 32869 - DNA, 953 bp, Homo sapiens
ggagctaggagtccaccaacagactaacagccttcagtgaactcagggatcccaaaggacaggaacagcttgaaagtacttgcatccttcctgcagggaccagccctttgcctccaaaagcaataggaaatttaaaagatttcactgagaaggggccacgtttaagttataatgtctaaggagaagtcacttcaaaatgcagcatcacatacaataggaatttgggttccagagtcagacatatctaggtttgaaaactggatctgccacttatcagttatgtgaccttaaagaactccgttaatttctcagagcctcagtttccttgtctataagttgggagtaatattaatactatcatttttccaaggattgatgtgaacattaatgaggtgaaatgacagatgtgtatcatggttcctaataaacatccaaaatatagtacttactattgtcattattattacttgtttgaagctaaagacctcacaatagaatcccatccagcccaccagacagagctctgagttttctagtttggaagagctattaaataacaacgtctagtgtcaattctatacttgttatggtcaagtactgggctcagcattttacattcattgtctctttaagttctagcaatgtgaagcaggaactatgattatattgactacataaatgaagaaattgaggctcagatacattaagtaattctcccagggtcacacagctagaactggcaaagcctgggattgatccatgatcttccagcattgaagaatcataaatgtaaataactgcaaggccttttcctcagaagagctcctggtgcttgcaccaacccactagcacttgttctctacaggggaacatctgtgggcctgggaatcactgcacgtcgcaagagatgttgcttctgatgaattattgttcctgtcagtggtgtgaaggca

SEQ ID NO: 32870 - DNA, 337 bp, Homo sapiens
acttggatgtctttatcagcagcatgaaaacggactaagacagggtttcaacatatgaattttgagggggcacacagattcagttcacagcagtgaggatgcagggaaatgaagactctctacgctttgggttggaatttaaacttgtaaattagacttgtaaagtcttcagagactcacatatgacttgcgagatcaaggctgtgttctggcaggtctctcaccattggcaaaaaaaccaaaaaagtatcattcccattgaatatcctgctacataatgaattttcacattgaacatttaatttcccatttaaataaacccatctggaatttgatt

SEQ ID NO: 32871 - DNA, 532 bp, Homo sapiens
accaacccccacccactaccccccatctccaaaaatggacactcctagaaatctactctcaagtagcttttctcatggacttaagtccccatcggtgacacggagggaaaagaacttcagaaccaactgttggccctgaaaagacctcaaagagggtgcaatccagttgatttttacattgaaaggtcacagttccccctctgagagtctgacggattgtacaacccctccccaggaacctgtatacacagtcaccacccatgaagcagtctcaggctaagaactctattatggaccgtagcccaatctgttcattttacagatgaggcaactgagtccacaggagagcagaacgtgacgtgcgtagaacacaaagttagttagaggcagacctaggacccaggtaaccagaccctcagtcacgtgggccttctggtaagaggccacctctagtgccttcagaaggcagaaacaaactgtcccttgacctattgggattctggtaaaagaaagtatttaatttgaaaaaaaa

SEQ ID NO: 32872 - DNA, 524 bp, Homo sapiens
gtgaaatctgactacttaactcttctccgtggtgctctgacaaacttgccttatttgctgtgagttgaaaggataaaacagacacacactttaatttttcccatttaactcttcacatactatattcatataggttttcactggatggggaaagagagcagaggtcggcaaacattttgtaaaggacagattttgtaaatgctttgtgggacatatggtctcttaaaactagtaagctttgctgtgagtatgaaagtgtctgtagctagtatgtaaacaaaggagtgtcactgtgcttcaatacaactttattatggacactgaaatttgaatttcatgtgatggtcatgtgtcgtgaaatattattgttttgaattatgtttccagccattaaaaaaatgtaaaatctcagccgggcacagcggctcatgcctgtaattctgccactttgggaggctgaggcaggcggatcacttgaggtcaggagttcgtgaccagcctggctaacatggggaaaccttgtc

SEQ ID NO: 32873 - DNA, 338 bp, Homo sapiens
gtcttacaatcagttaatatgagtcttccaacttttttttttaaatctaaattgtttttactattctcattcattggcctttccatacagatattagagttagcttgttaggcagacatgggaggatagcttgagcccaggagttcaagaccagcctgggcaatagagtgagactttgtctctacaaaatataaaaattagccaaacttagtgatgcatgcctgtagtcccagctactcaggaggctgaggtgagaggaacacttgcgcccaggaggcagaggttacagtgagcagagatcatatcactgcactccagcctgggtgacagagcaagac

SEQ ID NO: 32874 - DNA, 362 bp, Homo sapiens
gagattttctactacctctaggaactatacaatattctgtatgtgttcccttggttgcatgacaatattcaagacaactttgtaaataatagataaaaaattttaatttttaacatctagtctttctagatgtatagagtctcacaaagtataattttgtaaataagtcattgtaaaatttcatggtttcattgtgttttgcaaatgtcttggcaaagaacttgataaaattttgggcttcttgacctatacatattttggtatctctttattgggttgtttagtgtaaggaaaaagttgaaagaatgtattttcaactttgaattgtaatcagaaagaaaatatattttaaccattgttta

SEQ ID NO: 32875 - DNA, 298 bp, Homo sapiens
  misc_feature (75)..(75): n is a, c, g, or t
  misc_feature (89)..(89): n is a, c, g, or t
  misc_feature (201)..(201): n is a, c, g, or t
aaatcatccactttcccgagaatctagggattatgctccactgtctagagactatgcataccatgattatggtcnttctagttgggatnaacatttctctagaggatatagtgattgtgatggctgtggtgaggtgatgttagagatcattctgaacgtccaagtggaagttcttatagagatgcatttcagagatagggnacctctcatggtgcaccatctgcaggagtgcctctgttgtcttatggtggaagcagccaccatgattatagcaataaatgagatagatatggcataa

SEQ ID NO: 32876 - DNA, 528 bp, Homo sapiens
caagaccagtctggccataatttcagatggtgagattatagtgaaaccccatctctactaaaaatgcaaaaattagctgggcgtgatggcacacatctacaattccagctactcaggaggctgaggctgcagtgagctgagatcgcaccactgcactctagcctgggcaacacagtgagactccatctaaaaaaaaatctgagattaataggttgccattttaggcgctctttatagaccagctggcctagtggtcctggttctgtaatatgtgaagtaaaggtctcgcaggggagcaccagtttcaaactctgtcctagtttgcagccttggctggagtgaccccagtcatgaggcaaactgagcacaagtgtgcaagtgtcatggattcagccagaacatcagtgttcccagcatcagacacagattcgggagaaatcaagtcacagtgtagagatgtattgtgatgtgtcactacactattatgaaatggaagaaaataaaattacaagcctcaacctttaaaca

SEQ ID NO: 32877 - DNA, 540 bp, Homo sapiens
gaattttaaattttattcatacaataaacattcatcggacacttattttatgccaagctgtgctctgtttgctgaagatacatcagagaacaaaagagatatcaatcgctgtccttatggaacttatagtctaattgggagagatacaatagacaacatgatgaatggcaaagtatatagtatgctaaaggtaatatgctatgaaaaacagaacaaaggaagggggattggagtctcagccattgaggaaggaaggtggcaatttaaaatagagtagaaaggtttggcattaggccaggagtgttggctcctgcttgtaatcccaacactttgggaggtcaaagcaggccgatcgctggagcccaggagttcgagaccagcctgagcaacatggcagaactccatatctacaaaaagtagcagggtgtggtggtgtgcgcctgtcgtcccaactactcagggggctgaggcaggaggatcacctgagccttaggagttcaaggctgcagtgagccgtgatcataccactgcactccagcc

SEQ ID NO: 32878 - DNA, 428 bp, Homo sapiens
aattataatatattcatattaaaaaataatattcagtcttaaagcaaatagttaaagcaactaaaccagttgtaataggcagatttccaaaaaacggttatgtaagaaaacaagatacaaacattgtaatatcatttcatgttttcaatataaattatttaaaaatttcatatatgtatatgtatgtttaccaaactatgtgagtactgagaaaaatatgaaagaatgcatgcttgattgtcatatcccatgggtgtgtaatgggagtagtgaagaagataaatggggtagtataaaaaatataaaaccataatacactaaaatgtaatatgaatgttatactttacatttgtttaaaattacatatgtgatttgtacaactaaagtggtataaaaattagaagcaaagttaaatgagaaggaattga

SEQ ID NO: 32879 - DNA, 402 bp, Homo sapiens
gccatccttttccactggcctctactcggcatgcatgagaaagactggaaacagcacagtaggcctgggagacccttcccccttggtggtacagccctacagcacctgccaaggttttagggtggagcaggcatacctagggaagcccattcatgctttgagccttgtctgaggacaaggtagtgcctgtctgcccctgggggaggggcaagaaacacactctgatataaattagcggtctactattgccaggtgaaggacagaaatctctcttgggccccagacactccaccactacaaagtcagagttcagtagctacaggagaaaggggaggaaacctgcctgtgctctagatccagaactcagcaggaagcagaggttatccctaggagaagccctga

SEQ ID NO: 32880 - DNA, 1045 bp, Homo sapiens
ctgcgtacctcatataaatagagtgatatgttagtcgtctcttgtgtctggtttcttcctcttagcatcatgttttgaaagtttatccctgcgacagcatctaccagttcatcatttctttttgtggctaagtaatacgccattgtatggatataccacattttgtgtatccattcattagttcatggattttgtgtctattatgaataatgctgccatgagcatctgtgttgtccacaagtttcagcatggacttctgttttcattccaatatcctttgatgacatgtcttggcagtgatgtctatgacactgggcaagtgtcttaaaatgttgtgcatcagaaaaaagtcatcattgccaaggccagcagatctcgaaaagggggctgggatacgttggtgatttttttcatgctctacttacagtatgactcgtaactgttaatggctgagctcctccttaggtgaagaaggaaggcaatggcgttttctattctgggcctccctgcttccagcgatagcaaggagcgaaatgagatgctgtctaagaaaggaaggtgctgcgatctttgattactacacagcctcggcagtgtttgtatgattaatgagtccatgtttcagacgttcccatttaatgtatttgagccttctaacaacattgcctttcatatgttgctgactgtttttgagatttatgaggcctaactcgcaagcgatgtgtgtctggattaagagaacctgagaatctctatttatgtctgacccccaggaaattccctttaagctgcttatcagaggtgcatgctgagagcatgatgggaagatggagtcttccatccgctggtaaaatctggaatctgctctcatttcattttcactgaactgaaaataaggtaacagaccctcaggtctacctataagtaccttccaactgttccacttttgtaaatttagttcagataatacatatgctgaaattcctatatcccccccatactccagatcttcagtgtggaatttaaatataattccttattgtaa

SEQ ID NO: 32881 - DNA, 271 bp, Homo sapiens
tagttataaattttccatctaatttcttctttatgtattctatttatttgctgaaacttcttatctttccattcatttcaagaaagttttctcttcttggagcattactataatagctattttaaagtcttgtcaaataattctctgtcatcttagtgttagtgtttgttgattgtctttcccatgagaattgagatttgtttttgttcttcataggctgagtaatttgggttgtatccagggcaatttgaatatgctgtatgttaggaga

SEQ ID NO: 32882 - DNA, 481 bp, Homo sapiens
catgagccaccacgccagccttctgggagttcttaagggcaggtggcactgagatatatgagtaccgagaggtaaggacactcataactagaacacacatctgtctctacctttaaagctcatgtgatctgctgtggaggttcagaccacaggggaacaatagacagatggcccaattacatcgtgtgggtgtatgtcatattcaaaccatctacagaagtacccagggtgcagactacatgcccagagctcatggatttgagagtgagctacacttgaaaaatggaaatttcctcccttctctcctccccagaagaagaaaaaatataacacttcctcctctttgcatccaagtcctagtcctttctttccttgtggtttgtttttaatctagtgcttttataagaatcctttatatttgaataaaaatgctgaagaacccactgcagtttgccaatttgtcattcacactgggaggtgg

SEQ ID NO: 32883 - DNA, 584 bp, Homo sapiens
gtaatacttctgtagtttttctgccctggtgaagcctgcttataactcaaaatccagggtgtttactggggtctggtcatgtaggcacctctgcctgtgtgcctaaccacagtcacctgaattccagacccagaaggaaagtaggtgttcaccacaaatcatgttatttttgcagtttacgcaagctggccccgcaggttgtgtcccaggcaggcagagcaatgtaacatgccaaaagtcaagttctcagacaccagccaagggccagcctcataagcagacccttctaaagatagcagcatcagacctgctatcccttacctttatttactaatacattgtaaggcaaagaatccagtttcttgcccccacaaaggagcagaaacagcaagatactctctagcaacccatctccctcacttatttcagatacttgtaaagatatatgttgaaatgacagcaattctaacatatagaacttttttattgataaagctagataacgctaacatactaatagtatcttagttcatttcctgttgcttatgatagaaatcttctgggtaattaataaaagaaatgca

SEQ ID NO: 32884 - DNA, 321 bp, Homo sapiens
gacctttcaaaaactgttttttaaatagactttatgttttagagaagttttaggttcacaacagcattgagcagaaagtaaagagagttcccttgcattcctttcccatcccgtattagaagaagagggatcaagggtaactcttgctcaccccaaggagggttgttgggtggtataatttttgtatggcatgagcttcagagtatttgaagtttttgaaggggagggaaagaaaagtagtgtcgaagagagaatacagagcataaaaagacatctcttttagggccttcagtcaatataaagggtgtaaataaaaaaatt

SEQ ID NO: 32885 - DNA, 1060 bp, Homo sapiens
gggcactcccccgggagtgagggttgctgggcctgatgacgtggcttggcaacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggcttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggtttgtttcaaaagccattttcttctgggaaaactattaccaaacaccagataattggatcactaaaaattcctggtagaaaagaatttaaagacaaaaagttaaatgatcctaggaaactagtgggaaactgagaaatcataaaattgtactctgaagaaaaagatttcaaaatctaccagcagacaagaatatagataatggaaaacagaatactgtcctttttttttttctttctttttttgagaaagagtcttgctccatcgcccaggctgcagtgcagtgacacgatcttgtctcactgcaacctctgcctcccgggttcaagcgattctcctgcctcagcctcctgagtagctggaattacaggcacccaccaccacacccagctcatttttgtatttttagtagagacggggcttcattcaccacattggccagcctggtcttgaactcctgacctcaggtgatctgcctgcctcggcctcacaaagtgctaggattacaggcatgagccacagcacccggcccagaataagaatac

SEQ ID NO: 32886 - DNA, 3026 bp, Homo sapiens
  misc_feature (2846)..(2846): n is a, c, g, or t
gggcactcccccgggagtgagggttgctgggcctgatgacgtggcttggcaacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggcttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggtttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgttttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacatcatatgcatggacacagtgaccatgggcatggtcacagccacggatctgcgggtggaggcatgaatgctaacatgaggggtgtatttctacatgttttggcagatactcttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcnaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatgg

SEQ ID NO: 32887 - DNA, 3238 bp, Homo sapiens
  misc_feature (2846)..(2846): n is a, c, g, or t
gggcactcccccgggagtgagggttgctgggcctgatgacgtggcttggcaacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggcttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggtttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgttttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacatcatatgcatggacacagtgaccatgggcatggtcacagccacggatctgcgggtggaggcatgaatgctaacatgaggggtgtatttctacatgttttggcagatactcttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcnaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaatgtaaactaaattatttgggagaaacttcaaccactgatatgagataagcaatgagaatagggaagtgtataacatcacagtttttgatgtattacaaaaatcaaccactctataaaataaattttttttacttttggt

SEQ ID NO: 32888 - DNA, 1639 bp, Homo sapiens
  misc_feature (1459)..(1459): n is a, c, g, or t
ctgactctagcaggatccccatgaggctcctggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgttttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacatcatatgcatggacacagtgaccatgggcatggtcacagccacggatctgcgggtggaggcatgaatgctaacatgaggggtgtatttctacatgttttggcagatactcttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcnaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatgg

SEQ ID NO: 32889 - DNA, 2417 bp, Homo sapiens
gggcactcccccgggagtgagggttgctgggcctgatgacgtggcttggcaacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggcttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggtttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgttttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacatcatatgcatggacacagtgaccatgggcatggtcacagccacggatctgcgggtggaggcatgaatgctaacatgaggggtgtatttctacatgttttggcagatactcttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacggtactgtatgtaatttcttcactactttcttccttgaaaatcacatttttgaagtctttgctggaagtaaaacagacaaccaaataaataataaaacaaaacgaggccaaaaaagaaatat

SEQ ID NO: 32890 - DNA, 3139 bp, Homo sapiens
  misc_feature (2747)..(2747): n is a, c, g, or t
gggcactcccccgggagtgagggttgctgggcctgatgacgtggcttggcaacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggcttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggtttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgttttttgtgtttatggagtcagtggctagattgattgatcctccagaattagacactcacatgttaacaccatgcccatagccatgcccatggagcttctcaaggaagctgtcactcatctgatcacagccattcacatcatatgcatggacacagtgaccatgggcatggtcacagccacggatctgcgggtggaggcatgaatgctaacatgaggggtgtatttctacatgttttggcagatactcttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatactcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcnaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaatgtaaactaaattatttgggagaaacttcaaccactgatatgagataagcaatgagaatagggaagtgtataacatcacagtttttgatgtattacaaaaatcaaccactctataaaataaattttttttacttttggt

SEQ ID NO: 32891 - DNA, 438 bp, Homo sapiens
atttgaaaaaaagtattgtgtactgatgccctagactagagagcctctatctgtcactgtccccctgtataaattcctcagctgtactcaggaagacctaagtggtgaataaatgccctcagttgtgggctggtacctgtggcaggtcccctgagttttctagcattggctattggattaatggtttgtcttttattgagcaatagtttgttgtgatttaagggtgccatgcttacattctcttatcatgtattccctgggaatctaatttgtaaataattacttgacagaaactgaactggctggaaaattctgagtatgcagaggcagaggcaggccctgggaggggacttcagctgaaaggctgagcacctgaatggtctgaccacaatttctcatctcagcagttagcagctaataaggtcccctgttaaaaaa

SEQ ID NO: 32892 - DNA, 378 bp, Homo sapiens
ggctcaagtgatcctcccgccttggcctcccaaagtgcagggattgcgggagtgagccaccactcctagcccatttttttttctttgaatatttgtccttacccacaaagcatgaatttgttagtgaaattcattcatctttgttctctacccccattgatggagttgccaatgggttggaaaagtgtgataatactcatttctctctactctttttgagccgtgcttagttttgcagccctcttctggcagctatgacctagctttgtggtttgtgtatgtatgagtatatatacatatatatgttttctgaccttagtttctagttccgttttatatccctaccccatcctccttgttgatacataacaagtgtag

SEQ ID NO: 32893 - DNA, 343 bp, Homo sapiens
aattaatgcattaagcactcatctatgcacttttcatggcatagagccatttcatcctcatggcaactcaacggtttaagtgccaggtgtagccccatttcacagatgaactagttgaggcatagagaagttcatctgactgtcccagggtccctcgttagtaactagcagagcctggatttgaactgcagcattctgactccacagcctgtgctcccccccaccggattccactgccattgggtgggttttgtgtctatccacaggtgcctcttgaaacaggtggggcagttgtgtcatgtgattttgagcaagttgtttcttttcttcaggcttctgcacc

SEQ ID NO: 32894 - DNA, 408 bp, Homo sapiens
  misc_feature (364)..(364): n is a, c, g, or t
gaatttttagtttcaggagtcagtgaccttcaaggatgtgtccatagatttctcttgggaagagtggattcaagcagattctgctcagaggatgaccgtgtatggggaggtgatgctggagaactacaggaacccggtctcactgggtaaggacttcttgtaactcaaaacccacctcttgacaatcataaggcctgatcataaggcattgttttagggtgtttgcttggtgtcctctctttcaaggcagaagattgaaattttctgtaggagaatgggaaaatgggggaacttcataagccacaccttccttgttttcagaagccctgaagggagaaatgatccagaactctgctagggattnggtttttagggctcagtttcaggaaccccaattttatgtctctc

SEQ ID NO: 32895 - DNA, 540 bp, Homo sapiens
ttctggtgattatctgctgttatgtgaaacacactttacaaaatattgttaaagaaacagaagctcataacaggaattcaaacaatatattataagccagttcaggataattcatagaggatattccttatttttttcatcagtcagcgtttcaaaatgaattaagaacacctgaaacgttaaaatggcggtaattggctttttcccagctaaaaacaagagctaacaaaagcagagatcggtagcgaatgcaaggatgctgtaaatcatttttgtctacttgaaaattcactccttgatttacatacttagagaatgggactaattctctatcatacccaggaaaaaaaaaaagaaaagcaaggaagcatgcaaacaaactaaagaaaaatggggttaataaaggaaaacttagaaaagtgagggaagaagaaacgagagaaaatgaagttagaggaatactgatggacataactttcttaaaagggcgttggctttttaaattgcaaggtcacataatgttcattgtagaaaaagaaa

SEQ ID NO: 32896 - DNA, 444 bp, Homo sapiens
ggaaatcagatgagtgtttgccaggggctgggcagagagtggaatggggaatgactaactaatgggtccaggattttcttttgtggtagtgaaaatgatttgccactacatagtggtaatgcttgcactgcattgtgagtgtcctaaatgccattgaaattaatacattttaatggttaattttatgttatatgaagtttacaaactcagtttttaaaagtgccaatacttttaaagctatcattatttccatgaattattaattatatttgaaaagtactccagttatcagtgaaacaaacttgttttaacagctatagtacatggtggccagtcaaggtgcctcgtgcctgtaatcctagcactttgggagtccaagatgggaggatcgcttgagaccagtggttcgagatcagcctggtcaacagagtgaaaccccatatc

SEQ ID NO: 32897 - DNA, 633 bp, Homo sapiens
atttttaaagtatattttgttttgctgggattacaggcatgagccaccgtgccaggcctatgtttgtttcttttgccaacaatacccagagcctaggacagcatctggaaatgactgatcctttgatatgtactaaaggaataattcaacagattatatgtttcaaagtgagacagacatggtgtggtagtcttcctccaggatggcacccaagggctccacctcctgatattcttccatttgtgtagttccttcccacactagtaggattggtctccactaccaaaagagtacagcagaagtgatagcatgttacatataagatgggcttataaaaggcactgttgcttctaatttgattgctatctctctttcttctatcacttgctctggaggaagccagttgctatgtcatgaactgctctatgaagaagcctgtttgtcaaggatctgaagcctcctgccaatagctgcatgaacgagtttggaagatccagttctacccttcagatgactgtagcttgacgtcaacctcatgagagaccctgagacagaaccacaaagcgaagtccctcctggatccctgatgctacacaactatgtaataaatgtttgctgttttaaaaaattagt

SEQ ID NO: 32898 - DNA, 431 bp, Homo sapiens
gtggtgtggtcctgcaactccagggcagacctagactcatgggaaagtccctgctttgtgatgaggctgaaagaggatgagtggggagtggccggaagaagaaagggtgtaaccagagaccagtgtcaacaaggaatctggcttggaacgcttttgtctgcagccctctttggagcgtgacttgctctttcagagagccagttgctatgtcatgaactgctctatgaagaagcctgtttgtcaaggatctgaagcctcctgccaatagctgcatgaacgagtttggaagatccagttctacccttcagatgactgtagcttgacgtcaacctcatgagagaccctgagacagaaccacaaagcgaagtccctcctggatccctgatgctacacaactatgtaataaatgtttgctgttttaaaaaattagt

SEQ ID NO: 32899 - DNA, 406 bp, Homo sapiens
acagaagcaacattcaaattaacatcagtcaactgatggaatattttagatgaagtaagagaagccaaggcatgtaccctcaggctctgggcttctccctgcaaggttgggaagaaatttggaggaggcaaagtgggagcaagtcagatggaagagacattatgggtcagagccagttgctatgtcatgaactgctctatgaagaagcctgtttgtcaaggatctgaagcctcctgccaatagctgcatgaacgagtttggaagatccagttctacccttcagatgactgtagcttgacgtcaacctcatgagagaccctgagacagaaccacaaagcgaagtccctcctggatccctgatgctacacaactatgtaataaatgtttgctgttttaaaaaattagt

SEQ ID NO: 32900 - DNA, 616 bp, Homo sapiens
gtggtgtggtcctgcaactccagggcagacctagactcatgggaaagtccctgctttgtgatgaggctgaaagaggatgagtggggagtggccggaagaagaaagggtgtaaccagagaccagtgtcaacaaggaatctggcttggaacgcttttgtctgcagccctctttggagcgtgacttgctctttcagaggtctgtatttctctacctggactaccctgagagctaaccccagttattggtctggaagcaacgaatgaaggccggggcagagcttgaggagggcaacatcattttgtcacagtcgccatcaagaatctagttgcagactgggcgctgtggctcacgcctgtaatccctgcactttgggagccaagagccagttgctatgtcatgaactgctctatgaagaagcctgtttgtcaaggatctgaagcctcctgccaatagctgcatgaacgagtttggaagatccagttctacccttcagatgactgtagcttgacgtcaacctcatgagagaccctgagacagaaccacaaagcgaagtccctcctggatccctgatgctacacaactatgtaataaatgtttgctgttttaaaaaattagt

SEQ ID NO: 32901 - DNA, 365 bp, Homo sapiens
tttccagacctcactgcaagaccccctaccccaggctcaagtcagagagagaggaggtggcagtgccggaatttcagctgcgcatccgtcccagctctgcactgcgggcgtccgtcccagctctgcactgcgtgcgtcccgccctggctggagcttgcagacggcagccctgcaggaacccaccggggctgactccttcctccccagatcccacaaaacagcagtggatctccactcggcacgcattcccctctacattcacacgaagtgtcttttaatggaaagtgtataaactcgttaattttggttactgcactgaagttaggcaagcttctgcagctttattaaatgaccaatgctgtccc

SEQ ID NO: 32902 - DNA, 1127 bp, Homo sapiens
atgaagagagtttttctaattgaaaaatctttaagtcattcagaagaataaaactgaaaatgtttccaataactgagccctagaagctcttaggtctgaagggttcagtcccagtgaagtccacaagggcaatatgagggccctcactggggtgtctctgcatggggaagcaggtagtactgtgagccaggagcaagtctggggttcctttcctttcctgcttccaccatgtatttagccttttttcacagcttcagcggtggcctgtgctctccaaggcactctggacatgtgtctgtccacctccccaagtgctggcttttagctaatgtaagctccattgggatgcagcatctgtgtcttcttgaaggaactgcggcatcttggcaagttcagtcattgattcttaggcaggtgggtctcagtgttttggcctctctcaactctgggaatgtctccttgccctgtgtataccaacacaacagccaacatgcacgagagttcaaaaagggcagctggggtgatacttacctgattcggtgttttcaaatttccgagtttcacccttagggagctagtttgcagtttggttctttgcagtttggttctgagagccattcctgaagttcagttgaaaatctgccttcacctttccatcaaattttaagttatctttaacccctaataaatctctataggcttaaactatttgagtgtgctgtttcttttcctaaaaaccagaaaaggaaatatgagtgatatcacattcaattttatgtctacaaacttattacatcctttttaaaaataatgttcttaaagaaatgaatctaggccgggcacggtggctcatgcctgtaatcccagcactttcggaggccgaggtggtcggatcacgaggttaggagattgagaccatcctggctaacacagtgaaaccccatctctaataaaaatacaaaaaaactagccgggcgtggtggcaggtgcctgtagtcccagctactctggaggctgaggcaggaggatggtgtgaacctgggaggcagagcttgcagtgagccgagatcgcgccaccacactccagcctgagcgacagagcaagactccgtctcagaaaaaaaaaa

SEQ ID NO: 32903 - DNA, 408 bp, Homo sapiens
tcctcagtgtgggggcttcattcaatcagttgaagtcctgagaaaaaaagatggccctcccacagtgagaattatcctgttcaacagcatttcggacttgtcagcctccataatcatgtgagctaatgccttagagtaaaactgcctgtctgtctgtctgtctgtctatctatcatctatctttctatctatctgtctattgcctactgtttgtttctctggagtactctgttatgtctgcatttctgtcaccttcatctgttgacaatatggggttaatattgccttgattctcagactgtgtggttggagggaagtgacattcttgtcaagtcaaatggctttgttaaaataatctcagaaaagctgggtgtgtcctgtaatcccagcactttgggaggtcaaggt

SEQ ID NO: 32904 - DNA, 266 bp, Homo sapiens
tgcttcaggtccttaaattatccacttaattctaatgtgaaaaccattctctttgtcatatggcaacttagagtcaacatttttatattcaaagtctttaactgagaaaactaagcactagaaactttcctctccttgtttcttgctgccaggcaagcagaaacaaacctagaaatgtgtttaaaagtagaacggtgtcagcagtgaatggctgactaacgtccactgctgaagagcctcttgtgatgtgtaaaatagaacatcgt

SEQ ID NO: 32905 - DNA, 462 bp, Homo sapiens
ttcttgggaggctgaggtgggagaattgcttgaacccgggaggcggagattgcagtgagccgagatcacgccactcactgcactccagtctgggcaatgggaatgagaccctgtctcagaaaaatgtaaaaaagtgcttgctgctgttgtaaccaagcgagttatagagaaacaccacactttgagacaaattgaggagtcctttattagctggcaaccgagaggcagctaatgctcaaaattctcttggccctgaggaaggggctagttttgtttttatactgtggtctaaataggggaggggggagtttagctgaagcaatttttacagaagcagaactggcaaaaagttaaaaaattaattggttacaaaagcagttacaaaaaataaacagttccaggtgcaggggcttaaactatcacaaagggataaatgcaggggctttatgtgccatccactgc

SEQ ID NO: 32906 - DNA, 594 bp, Homo sapiens
acacggacaatggtgaacacatgaaaagcacttcgcgggacatgctggggaacccactaaccaatagtcttttattgactttccttgtgttactggtttaaacaaattttttttgctctttttgtttgttttctagtagagtagtcaccaatgtttgtgtagacagagggttaaatctctgagtcagaactccccgctttctttcagcatattcaaagatttcaggatgcatgagcaaaaggtatcaaatggtttccatttaaaaggggacttgaaattgagccatagggcttggctgcagtcctcatgctaagagatttcaatggggacaggctaacctttttattgaggagatgtttgcccattaccaagaggagaaataaagcaggaaagaggtgcagaggcatcccaggaaccaaatgaaatggcctctttaaatggccattgttactatttccaacatatttttttttttttttttttttttttttgagacagagtctcgctctgttgcccagactggactgcagtggtgtgatctcggctcactgcaacctccgcctcctgggctcaagcgattctcctgcctcagcc

SEQ ID NO: 32907 - DNA, 115 bp, Homo sapiens
cttcaggataaaatatcacaattagaagaatggtttttaattcagcccctgaaaggaagcctttgctagaaaatgatggatgagggtagaagagcaaagagaaagaggaaaacaa

SEQ ID NO: 32908 - DNA, 384 bp, Homo sapiens
gttctacagatcactcaaatgtaacaccttcccttcctgccttcaacagatatgacatccccccagctgcttgagccaaaaactggttgtcatcctcgcctttccctcactgtctcctctctgttgcagttaactaccaagttctatcaattctaacttttaaaaacctgccattcgggtggatcacgaggtcaggagaccaagaccatcctggccaacatggtaaaaccctgtctactaaaatacaaaaaattagctgggcatggtggcacgcacctttagttctagctacccgggagactgaggcaggggaatcacttgaactggggaggcggaggttgcagtgagctgagatcatgccattgcactctagcctggcgacag

SEQ ID NO: 32909 - DNA, 449 bp, Homo sapiens
gaaattgcttcattgcacttgagcctgggcaacaacagtgaaactccattgagtataaatggataataataataattaatgataatcacattattattataacttagaaaaatactctactagtgaacatttcaattattaatgataacaatgcatcagtatataagaataaaatataaatgaccaatgagcacatagatgcttagcatctcttttcattagaaaaatgcaaatcaaaaccacaattaaatgtcagtttacacacactaggataggtatattcaagaaaagaaataaatgtggatgagaatgtggagaaattagaaccctcataccgtgctgatggcatggtaaaataatacagccattttggaaaatattttggcaggtcctccacaggttaagatagagttaccatatagctcagcaattctactcctgagtatata

SEQ ID NO: 32910 - DNA, 5213 bp, Homo sapiens
cagccaggtcggccgcccccaccaggtccagttccagagcccaggccggtcggccgggcccgcgtgccctcggcgggctgcgcagagcgcgggagcggtttggggctgggcatgctgggagcccctcgggcaacggccgccgccgccacagccacacagccgccgccactgcgtccgtccccggtgagcgccgctgacgcgcggagatgaaattcccggcctcggtgctggcgtccgtgttcctgttcgtggccgagacaacggcggcgctcagcctgagcagcacctaccgctcgggcggggaccgcatgtggcaggcgctgacgttgcttttctcgctactgccttgcgcgctcgtgcagctcacgcttctcttcgtacaccgcgacctcagccgcgaccgcccgctcgtactgctgctgcacctgctgcaacttgggccccttttcaggtgttttgaagtcttctgcatctactttcagtcaggcaacaatgaagagccttatgtcagtatcaccaagaagaggcaaatgccaaaaaatggcctctcagaggagattgagaaggaggtgggccaggcagaaggcaaactaatcacccaccgatcagcgttcagccgggcgtcggtgatccaggctttcttgggctcagccccccagctgaccctacagctgtacataagtgtcatgcagcaggacgtcactgttggaagaagtctcctcatgaccatatccctgttgtccattgtgtatggagccttgcgctgcaacatcctagccatcaaaatcaagtacgatgagtatgaagtcaaagtgaagcctctggcctatgtctgtatcttcctgtggaggagctttgagattgccactcgagttgtagtcctggtcctctttacctccgtcctgaagacctgggtggtggttataatactcatcaacttcttcagtttcttcttgtacccctggatcctcttctggtgcagtggttccccattccctgagaacatagagaaggccctcagtagagtgggcaccaccattgtactatgctttctaactttactctatactggtatcaacatgttctgctggtctgctgtacagctgaaaattgacagccctgacctcatcagcaagtcccataattggtaccagctactggtgtattacatgataagattcatcgagaatgccatcctcctcctcctgtggtatcttttcaagactgacatctatatgtatgtgtgcgcacctctgttggtcctgcagctgctcattgggtactgcacagccattctcttcatgcttgtattctatcagttcttccacccttgcaaaaagctcttttcttccagtgtttctgaaggctttcagaggtggctcaggtgtttttgctgggcctgcaggcagcaaaaaccctgtgagccgataggaaaggaagatctacagtcatccagagatagagatgagacaccttctagcagtaaaacaagtcctgagcctggtcagttcttgaatgctgaagatctctgctctgcttaatgggacccaaggtctcagagcacaggcatattattttctgggtttgatactcgttattcatacaaataatgagccctacacagggaacaaggcaggaagttagctgttaactccttgtgagctgcttctctttatagagctcttgggtatgtagaactgtatgggaagaagccaggaaaacctctgagtgttgaaggggcaacccaaggcatcacagttcacaggtaaccatgttgtgttcttctaggcattactggccttttcactgacaagttacccctgaaatctgagttgtactggttagattcattaggttgaatgaggagaggggcttacctgttctctagttttccagactgctggtttgggtaacctgaagttttatgatccctgaacatagttttcacccaagagctgtcctggtgaccaaaaaagattactagggttttgccatcagcaacatcattcctgtcagagctttcagggagggctgttcaagtttggtttttgaatagacagaggtttcattttcatctcattagggcttttttgtacatagccaactgtagccaccctggcatgctgtctctaattgattcaagggcctagatttggagactttgttccttagcatccatggatgcagaaatgagtgataaatttggccatgaaagccctggaattttaggaaagttgtgattctttgatatgttgatgaaattctggatcaggaggggtgttaaaacatcaaaatgatggcgacttgtataagtagaattcttaccatcttactcctgcctccccattccttgcctgtcaggaccattttagaagagttaccttggttaacttaagggttttttagaaaaccccacagaaatctctcacccagttcaggtgtatagggaattttcattttcattatttcaaggaatagagttttcctcactaccacttgtaattagagattgacttcagaaactttttctaaattataaagacggaatgaccagaaaatttttgtctttcatggaatgcaatttgacttggcataattgtgagttaatttgataaagatctccagttgtatcctctgacaccctttaatgttctatataatttttcctttaatcggagaccctatttgtttcattaaagaggattgggtagcatatcctcaattatcttggaaaaatgcgtagatctagtgccattatttctaccattaaaatcttgaaagcgaaatacttgaaaagaggtgaccataaagatcacaccaatttagaatgaatattaaagtctgagaaatttacaaaagggactctatggactcgattttaccatatggaatagggatccacttctctgttaacctacaaaacgtatttatctggccattgcacttcggataattttcatttttaattcctcttggtgtcaaatttttaagtaatttcatgcacacaggagaaaatgcaatttgataatcagtttccactacattcggaggtcaagaaagcagtatatattctttcacaaggcatccatactgtttaatatttatagagttcatagaaatacatcaataagctcctaaattatagagcctcaattttggtttttctcatttgaaatgtttttgatttatcaatatttgtggtttaactttgtgggggtgtccaggcagtagatcattttttgtctatttttaaccaaataagaataacactcaagactatgttctccatcccaacacatcacttaccacttgcactattcttaataggcctaaaatagtgagcatatataatcaaaataatacttcatacaacatatacttccatgcactcttcatgtaatcacatatgtgcatagatacacaatcgtattacataaaacacccttgaaaatatatgactttgaataaaataaagctaccatgttaatacatcattttttgtttcttcctaattaacaaaagggctctataatgattaggagagctgtaaggccattctttagtcattccaagtgtatatttgtatcacaccagttacttgtgttcattgacaccaaatattttcaagctttttgtgagaaagagattcttgccttgaggctctgcagtggcaaatggtaggggcaatagcgctcccttttcacctgaaatgccttcagctcaggccttgggagtgaggtgtgggagtagccaccagcctcccactgactaggcatgttaggaattagacaaggatggagagactggttttttccagccttggtttggaagcttgtctcaaaaaccattacaaaatcttaaccttcaaatacattctaaatcactttaatttagaagataggtgagcaacttgagtgatcccaaaccaaactaacagtgctggtttgtccgacacccaaagcccacttcacacatttataaggacagagatttggtaactcatttgggtattttgtcagttttaacccttaatatacaggtatcccagctttgggcacatgtatgtccattcactttcaggaaggggtgtcagtactttctttctgtgtggtgaaaacataagccatggtgaactgataatttttgtttttaaattatttatattactgaattggcaaaattacagttcacactgcagagctaggttgtcctattggcataaaacaaaccagcaacttttctcatgtgtttggagttaaaatgtgtttttcagttataatttcaatttttaaatttcttggtgctttgtctaattaattacatcccataacttgtcaggatagttgctccaactgaattgctatcatttggctggatgggggtgaagtatgtcttcaaaatatattgaagtaagttcatcaaacatgtttagacttcctctcattgctggagacagcccagtgtagagattggcacttccctgtccagcactacaacttaattgctctatgcctcagtttccccataatacccttttccaacctacctcacaaggttatcagaaagatcaaattaaataatagatgtgaaaatgctttgaaaatgtttttaagtgctatgcatatttatagagttattatagttattcaaatccataagcaggttatttttatttttttactgtttgaaaagaaataagtagtgtcattcatatgagttcctgagtggatatgcgaatctttggtcttctcgacaggtgccctttctcttaccactagttgcttacaaaaatagcacccaaacacatggcacttggaagaaaaagacccactgaatctgagaaagtactttctggtggcaaatgaatttatcattttagtatagttttcgataaaggatatagcaacatcttttgataattgtgctttacaacttgaatgctgattcaaggcattatttggatgtgagtttaatcttttcagccttgtaaatgggaaaatatatattaaaattgattgtcaaatacagcatttctttggaaaccaccttaaaacattagtgctatggttatgagtgtatgtgccagtacttaccagtcaatgcattgtggatatgagctttcgttgactgcttctctgcagtcgttgatgctaataaatattgtcctgtttcttcatataataaattaatttttcaatttctccttgtaaaaa

SEQ ID NO: 32911 - DNA, 873 bp, Homo sapiens
cagccaggtcggccgcccccaccaggtccagttccagagcccaggccggtcggccgggcccgcgtgccctcggcgggctgcgcagagcgcgggagcggtttggggctgggcatgctgggagcccctcgggcaacggccgccgccgccacagccacacagccgccgccactgcgtccgtccccggtgagcgccgctgacgcgcggagatgaaattcccggcctcggtgctggcgtccgtgttcctgttcgtggccgagacaacggcggcgctcagcctgagcagcacctaccgctcgggcggggaccgcatgtggcaggcgctgacgttgcttttctcgctactgccttgcgcgctcgtgcagctcacgcttctcttcgtacaccgcgacctcagccgcgaccgcccgctcgtactgctgctgcacctgctgcaacttgggccccttttcaggtgttttgaagtcttctgcatctactttcagtcaggcaacaatgaagagccttatgtcagtatcaccaagaagaggcaaatgccaaaaaatggcctctcagaggagattgagaaggaggtgggccaggcagaaggcaaactaatcacccaccgatcagcgttcagccgggcgtcggtgatccaggctttcttgggctcagccccccagctgaccctacagctgtacataagtgtcatgcagcaggacgtcactgttggaagaagtacgtgtattttttatttctgcctgcatttggggatcaaaatgagaagcaaaatatgcagtttattttgtttcaaaggaaatttgttcttaagtgcacttaattctgaatctgtgttctagttactatgctcaaaactcaattaaaataacaacgttt

SEQ ID NO: 32912 - DNA, 518 bp, Homo sapiens
tggtgattgagttttatgcctctacaaaataggttgtgaattaacttcaacatctgttgaaatgcatcaactgggaaatgtccacctccttaatacagggctcaaataagaataataccttgggataccacaacatttacatttgataccccctgtgatcttagaggaagctactatacctaaaacaattatgccttcctttaaccatgaacatagtatcatttttgcctgcattctctataaatgtacccattgtgcaaagatatcccacagtggggatcgattccttgacttaatgagtcatgtattaaaattaaatattttccattttcaaatgttcttgacaaatcgggaacccctgggacccactagtttaaataagttaatatgggctaaacataatgttttggcaatatggtaaaatgttttggaagggttattggggtattcccattttcatccttttgcgagttttagtagattgggtctttcaaggaattaattggtccaactgatct

SEQ ID NO: 32913 - DNA, 701 bp, Homo sapiens
tcccctaaaatctctcctcttgacgtcttttttctggcataaggacccggagctttgaggagcgcagcagcccagaagctcctaaggagagaagctgttttggtgagattggttccaccaggctacatgccttgactgggacagaaatgggctgggaaggccgaaatttgacttctgcacctggatttgggctaaaaagtctcacagctcagcctccttgataagggttcttctatctcccctctatacttcctctgcagcagaaaagagtatcttggccgtgcagggaacgctcttctctcactctcgccactggggttaagggcagcctacattactatagctccaagtcttggttgcccccagagagaggcagagatgtagcctgcccacatctggacacttgaagactctccaaacacctagaggagctgtggattcaagtgaagcaaccatctgatgccaccacggtccctccttccctttgccttcccttcttcccacaaaagagaagcccaaatccgccaccagaccagcccatctgcccgtggaaaccaagggaaccaaatgcatcgtactgggttgcaggccttaatctactctcgctgaattattcagggatggcattaacttataaatgagtgtgtttgactgattttgtggttgatgtacagataaagtctaatgaaagacagttataa

SEQ ID NO: 32914 - DNA, 1518 bp, Homo sapiens
catgccaacttcattgaggggaaagaggaggaagcttcatattgagttaatgttttatacttttcaactcatttctccaaccttagttcatttgattcttaaagcatctactagtgtcagtagctgtacacttgtacacataaagctgaacaagatgaaaatggcatctcctggctgtgcaacacaatggtcctgctgaggatgtgaatataggacttgatagtcaactattcttgctatataaacagagatactgatgcagaagataagtaagtagtatttaagagttcacagtaaggtcattgcttttccccattttatgatttgtagtgctttctctgattccatttcctaaatctttcatccattaactatactatactatatactatagcagtagtttacctcaccctccttctatctcgctacacggactctttatcagtaaagttagcataacagtaggatcacttccctgacacatgttgtttgtgagaatgaaagtgagacaatgtaggtgaatacaactttattaactctagaatactttttatagaagttatttgtctttccatgtacctcagattttaccaactgatatttacttacctgcctctgaacacataaattttttaaaaggatgtgatttcttgctcatgtagttccctcagctcttctccctcagccttaccccttctcctcatgccattcaaagatcgtatgtgtttcaagaagactacactcagctgacacatccttcaggaaaccttctataattctgtgtcgtatatgaagataacctctccttatctcctgagttagccttgaaataccacacagtgatattgtgcctcatacaacattcatttgtataattggtttaggccatcttatagcctatatactcttcgaggaggggtactatatcttactgatgtttatattctctatacagaattttttaagaagagtcaaagaacaaatagtatttgttgaaattaattcaatttcattaaaccaatctacatcacgttctatctatattgtagcagttattggtgttaacttgcaaacattccattgaagttattagttgaatgctcgagcttagtgcaaaaaagctgattattaaatattcaggaattttgtgaatctgacaaagtgttggtaccttgaaattggcttcagtgggatcgtttatctcatggagattggcaaactcttaaaaacactgctttttgttttgggagagccatttaccggtatatcattggttgtatgtctgtaacccccactagagtatgagcttcttcaagttcatctctgcctgaatgcctcgactgtgataggaacattctttgctgaattaatgaataaataagtgattgagtatatcagctgctttattcctctactgcctgacccctgctggcagagaccgaatttcagaatctagtgaattttttgagactgagttttaaaatggtccattgtcatagactgtagtttctttctgct

SEQ ID NO: 32915 - DNA, 424 bp, Homo sapiens
tcctaaacgaaagagcccccaccttccgccagccaccacctcttctcagcttctctgtcctgccccaggcaccttccctgcctcaagttcccccaggggctccgtcttaaccactctggagcagtaagtccctcatgggaagggggcaccccaggaatctggacagagtgtaggtgtcccccatcttcatccaggtgatggttacatggaaggccccagaggggacccctgcacactccctgcactgcacacacttccctgtatgtgtggactcctcagtacagagcaaaaagattgtcctgtgaaaaaggaatgaaacattgattacaggtgagccaccgtgcctgtcatcacagccctttcggaggccgagttggaaggatcgcttgaggccgggagttcaagaccagcctgggcaacttag

SEQ ID NO: 32916 - DNA, 220 bp, Homo sapiens
actcctacccacctagtagggtagaggttcattaagaaaattatgtgccttaaagggaatagataattacatttttaaaaaacaactttgaggctgggggcggtagctcatgcctataatcctagcacttggggaggctgaggcaggtggattgcttgagcccaggagttctaaatgagcttgggcaacatagggagaccccatctctaccaaaaaataa

SEQ ID NO: 32917 - DNA, 802 bp, Homo sapiens
tgagtatgaattctggtgtcagcattcactaagcatatgaccttggacaagtgatttaagtttcttttaaacagagaatagtaatacctacctcatattattattgtcagtgtatcatcttacaatcacagtctttctccttagggctgggctcagtgggtggattgacactgcagaaatggccagatctaaaggatcaacatttacgtagctgggaaatgtagctgggacttcagtttcactgcccctggtgatttttcctaccactaagcagctcagtccatacccctacgagacccacaagcttatgagatactgttcttccaggaaagcagtggggccagggccaccttttaattgtgtttcttggcctggtcccatctttctcacaatacatagcaacagttatttacttgctgattttctaatgcacatcacacatagtcatattaaacacacacacacacacccacacacacccccacccctcaagaaacattttctgagacgtgatttcctgatttcatcaaaaaagaaaagagcgggccaggcacagtgggaagtcaaggtgggtggatcacttgaggtcaggagtttgaaaccagcctggccaacacggtggaacctcgtctctactaaaaatacaaaaattagccaggcgtggtggcgcacacctgtaatcccagctactggggaggctgaggcaggagaattgcttcaacctgcgaggctgaggttgcagtgagccgagattgcgccattgcactccagcctgggcaacagagtgagactctgtctcaaa

SEQ ID NO: 32918 - DNA, 311 bp, Homo sapiens
ctgaaagtcagagacatacttaagttctaattctagctgctctgcttctgacctcctgtggggccttaggcaacttgcactccttctctgggccttggtttccccagctttgacagctgatgtccctgagtcacgaaggggtacttctggcccacgaagcctgacaaaggacaggttttgccaaggctcttcagagaggtgccccccggggtaaggtgatccaaatgagcctgctcttccaggaagggaagcattggcacaagggctcccctcttgcctgcaggacctgtgggcacagacagtggcagcta

SEQ ID NO: 32919 - DNA, 393 bp, Homo sapiens
ggggcatttattacgtagaacaactgctgtatgcctaatataaaaggattataaatgtaactaaaatacctattataattatatacaacaaaagatacttgggataaatctaacatggcaagattgttttggatgaaacataaaattttttaaaatcaagtaggggaatgggttttgaggaaaggtactctgggagatttaattatgtctatgctgtttcatttcttagtggttaggagcaaagatgaaaaaaatactaagatttggccaggtgcggtggctcacacctgtaatcccagcactttgggaggccgaagtgggcagatcacgaggtcaggagttcgagaccagcctggccaacatggcgaaactccgtctctaccaaaaatacaa

SEQ ID NO: 32920 - DNA, 394 bp, Homo sapiens
cagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagctgagcgccctggacctgagccactgcgcccacgtcggggaccccagtgttcacctcctcacggcccccacgtccccactccgcgagaccctggtgcacctcaatcttgctggttgccaccgcctaacggaccactgcactccagcctgggtgacagagtgagactctctctctta

SEQ ID NO: 32921 - DNA, 4652 bp, Homo sapiens
cagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccggggctgcggagttcgtgtgtgtatctgcggggtccctacctacagatgagtgggctcacctctcctggactcagggagggatttggaagtgtggacacctggggtgtccagctgtaccttggagggggctggggttggcgtgcacctcggtggggtccgggcgcttggataacgttcttggtgggtaggggtcgcggggaatctctgcgggcccgggactgcggggacttggtccccggctccaccccatcatgtggctagccccggctccgcctctgtcccagttcctgttttggcctccgctgtcccgctccggctcctggggctccccgcagacgctgcttttcttgctccactgggggtgcctcttcctgggcgcccgccgcctgcatcctgctcgccctgtctgggaatggggccgcccccgggcttgggccggcccggctggggcccccgaggcgcttccgccccgtagtgaccgcctggtgccgccccccccccaggatgaagggcggcgagggggacgcgggcgagcaggccccgctgaaccctgagggcgagagccctgcaggctcggccacgtaccgggagttcgtgcaccgcggctacctggacctcatgggggccagtcagcactcgctgcgggcgctcagctggcgccgcctctacctcagccgggccaagctcaaagcttccagccgcacgtctgccttgctctcgggcttcgccatggtggccatggtggaggtgcagctggagagtgaccacgagtacccaccaggcctgctggtggccttcagtgcctgcaccaccgtgctggtggctgtgcacctctttgcactcatggtctccacgtgtctgctgccccacattgaagctgtgagcaacatccacaacctcaactctgtccaccagtcgccacaccagagactgcaccgctacgtggagctggcctggggcttctccactgccctgggcacctttctcttccttgctgaagttgtcctggttggttgggtcaagtttgtgcccattggggctcccttggacacaccgacccccatggtgcccacatcccgggtgcccgggactctggcaccagtggctacctcccttagtccagcttccaatctcccacggtcctctgcgtctgcagcaccgtcccaggctgagccagcctgcccaccccggcaagcctgtggtggtggtggggcccatgggccaggctggcaagcagccatggcctccacagccatcatggtacccgtggggctcgtgtttgtggcctttgccctgcatttctaccgctccttggtggcacacaagacagaccgctacaagcaggaactagaggaactgaatcgcctgcagggggagctgcaggctgtgtgagactggtgttagccaccgctcactgcaagcactgcctccctccggggtctgtaagaggccgcaggggcctacagacctcatccccccatcccctggctggagccacttccagtggccactctcaggcagagttcagattcctgcccgcagggtcctctgggctgggccttggggcagctcccacattcccagggattttccccatcagtctgtcccttgggttttgcaagctactctgcacctgggctggcctcagttgaaggatcatgcagtagatagaggggaggcagggagagcttgtgggaccttcagtgctgactttagccaccatttccattcctatacaggatgtgaaggtcagaaggcagccaattgttggtttaattttttttttttttgagacagtctgtttcccaggctggagtgtagtgatacagtcacagctcactgtagcctcgaccttccaggctcaaaagatgctcccaccacagcctcccaggtagtgagtagctggtactacaggtgtgtgctgccacacccgactaatttttttgtagagacggggtttcgctgttcccaggctggtctcaaactcctgggctcaagtgaacctcccgcctcggcctcccaaagtgctgggattcctttctttatttctgtagaatctattttatggttggcattttgggggaagatttcgatgggttccacattcttgctttagttgttgtagagggatttgggtgtttctacccaaggcattggtctagcttttcctacaatgaacctatctttggaggttcaagctccccaccttcccccactgtggtgacctgtggccacttgcagaagggatggtgcctgacccactgccctagccccacgctatgcaccaaacttgttctccccgtcctggtccagggctggggtctttagagactgacagcctctgccccaggcctgagtccttagcaagggttgggtaaggaggttttaagggagaaggtccagtccttagcccttgaaatacaaagctcttctgacactgaatttggatgcaccttgttttatataataaatcgtgtttcacaga

SEQ ID NO: 32922 - DNA, 2889 bp, Homo sapiens
  misc_feature (54)..(54): n is a, c, g, or t
  misc_feature (60)..(60): n is a, c, g, or t
  misc_feature (116)..(116): n is a, c, g, or t
  misc_feature (118)..(118): n is a, c, g, or t
  misc_feature (137)..(137): n is a, c, g, or t
  misc_feature (140)..(140): n is a, c, g, or t
  misc_feature (144)..(145): n is a, c, g, or t
  misc_feature (147)..(148): n is a, c, g, or t
  misc_feature (174)..(174): n is a, c, g, or t
cagacaagaaggagaaccccccagagatatcaagtgcagggggaaagaaggggngctgcngagtccctggttggaatccaagtcactgcactcaggatcccaggtggttaggtggnanctggcctcccagcagggtnaantganncnnaggtccaggctcctgtcgagtcgggnaagggtggggggcgcccaactagctgtccttgagaagcagcttctcctcagggcagcggaaggggccagggggcccggcagctgccagccgggcacaagcttcgggtgagagctggcggcaggagcgcaggtctaggcggcgtagacgacgggggacccagccgggctgggcccctgggccccgggtctgtacaatacggtttgctataaaactcaaaatcttccagccggggctgcggagttcgtgtgtgtatctgcggggtccctacctacagatgagtgggctcacctctcctggactcagggagggatttggaagtgtggacacctggggtgtccagctgtaccttggagggggctggggttggcgtgcacctcggtggggtccgggcgcttggataacgttcttggtgggtaggggtcgcggggaatctctgcgggcccgggactgcggggacttggtccccggctccaccccatcatgtggctagccccggctccgcctctgtcccagttcctgttttggcctccgctgtcccgctccggctcctggggctccccgcagacgctgcttttcttgctccactgggggtgcctcttcctgggcgcccgccgcctgcatcctgctcgccctgtctgggaatggggccgcccccgggcttgggccggcccggctggggcccccgaggcgcttccgccccgtagtgaccgcctggtgccgccccccccccaggatgaagggcggcgagggggacgcgggcgagcaggccccgctgaaccctgagggcgagagccctgcaggctcggccacgtaccgggagttcgtgcaccgcggctacctggacctcatgggggccagtcagcactcgctgcgggcgctcagctggcgccgcctctacctcagccgggccaagctcaaagcttccagccgcacgtctgccttgctctcgggcttcgccatggtggccatggtggaggtgcagctggagagtgaccacgagtacccaccaggcctgctggtggccttcagtgcctgcaccaccgtgctggtggctgtgcacctctttgcactcatggtctccacgtgtctgctgccccacattgaagctgtgagcaacatccacaacctcaactctgtccaccagtcgccacaccagagactgcaccgctacgtggagctggcctggggcttctccactgccctgggcacctttctcttccttgctgaagttgtcctggttggttgggtcaagtttgtgcccattggggctcccttggacacaccgacccccatggtgcccacatcccgggtgcccgggactctggcaccagtggctacctcccttagtccagcttccaatctcccacggtcctctgcgtctgcagcaccgtcccaggctgagccagcctgcccaccccggcaagcctgtggtggtggtggggcccatgggccaggctggcaagcagccatggcctccacagccatcatggtacccgtggggctcgtgtttgtggcctttgccctgcatttctaccgctccttggtggcacacaagacagaccgctacaagcaggaactagaggaactgaatcgcctgcagggggagctgcaggctgtgtgagactggtgttagccaccgctcactgcaagcactgcctccctccggggtctgtaagaggccgcaggggcctacagacctcatccccccatcccctggctggagccacttccagtggccactctcaggcagagttcagattcctgcccgcagggtcctctgggctgggccttggggcagctcccacattcccagggattttccccatcagtctgtcccttgggttttgcaagctactctgcacctgggctggcctcagttgaaggatcatgcagtagatagaggggaggcagggagagcttgtgggaccttcagtgctgactttagccaccatttccattcctatacaggatgtgaaggtcagaaggcagccaattgttggtttaattttttttttttttgagacagtctgtttcccaggctggagtgtagtgatacagtcacagctcactgtagcctcgaccttccaggctcaaaagatgctcccaccacagcctcccaggtagtgagtagctggtactacaggtgtgtgctgccacacccgactaatttttttgtagagacggggtttcgctgttcccaggctggtctcaaactcctgggctcaagtgaacctcccgcctcggcctcccaaagtgctgggattcctttctttatttctgtagaatctattttatggttggcattttgggggaagatttcgatgggttccacattcttgctttagttgttgtagagggatttgggtgtttctacccaaggcattggtctagcttttcctacaatgaacctatctttggaggttcaagctccccaccttcccccactgtggtgacctgtggccacttgcagaagggatggtgcctgacccactgccctagccccacgctatgcaccaaacttgttctccccgtcctggtccagggctggggtctttagagactgacagcctctgccccaggcctgagtccttagcaagggttgggtaaggaggttttaagggagaaggtccagtccttagcccttgaaatacaaagctcttctgacactgaatttggatgcaccttgttttatataataaatcgtgtttcacaga

SEQ ID NO: 32923 - DNA, 4900 bp, Homo sapiens
  misc_feature (4676)..(4677): n is a, c, g, or t
  misc_feature (4704)..(4704): n is a, c, g, or t
  misc_feature (4712)..(4712): n is a, c, g, or t
  misc_feature (4720)..(4720): n is a, c, g, or t
  misc_feature (4735)..(4735): n is a, c, g, or t
  misc_feature (4900)..(4900): n is a, c, g, or t
cagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccggggctgcggagttcgtgtgtgtatctgcggggtccctacctacagatgagtgggctcacctctcctggactcagggagggatttggaagtgtggacacctggggtgtccagctgtaccttggagggggctggggttggcgtgcacctcggtggggtccgggcgcttggataacgttcttggtgggtaggggtcgcggggaatctctgcgggcccgggactgcggggacttggtccccggctccaccccatcatgtggctagccccggctccgcctctgtcccagttcctgttttggcctccgctgtcccgctccggctcctggggctccccgcagacgctgcttttcttgctccactgggggtgcctcttcctgggcgcccgccgcctgcatcctgctcgccctgtctgggaatggggccgcccccgggcttgggccggcccggctggggcccccgaggcgcttccgccccgtagtgaccgcctggtgccgccccccccccaggatgaagggcggcgagggggacgcgggcgagcaggccccgctgaaccctgagggcgagagccctgcaggctcggccacgtaccgggagttcgtgcaccgcggctacctggacctcatgggggccagtcagcactcgctgcgggcgctcagctggcgccgcctctacctcagccgggccaagctcaaagcttccagccgcacgtctgccttgctctcgggcttcgccatggtggccatggtggaggtgcagctggagagtgaccacgagtacccaccaggcctgctggtggccttcagtgcctgcaccaccgtgctggtggctgtgcacctctttgcactcatggtctccacgtgtctgctgccccacattgaagctgtgagcaacatccacaacctcaactctgtccaccagtcgccacaccagagactgcaccgctacgtggagctggcctggggcttctccactgccctgggcacctttctcttccttgctgaagttgtcctggttggttgggtcaagtttgtgcccattggggctcccttggacacaccgacccccatggtgcccacatcccgggtgcccgggactctggcaccagtggctacctcccttagtccagcttccaatctcccacggtcctctgcgtctgcagcaccgtcccaggctgagccagcctgcccaccccggcaagcctgtggtggtggtggggcccatgggccaggctggcaagcagccatggcctccacagccatcatggtacccgtggggctcgtgtttgtggcctttgccctgcatttctaccgctccttggtggcacacaagacagaccgctacaagcaggaactagaggaactgaatcgcctgcagggggagctgcaggctgtgtgagactggtgttagccaccgctcactgcaagcactgcctccctccggggtctgtaagaggccgcaggggcctacagacctcatccccccatcccctggctggagccacttccagtggccactctcaggcagagttcagattcctgcccgcagggtcctctgggctgggccttggggcagctcccacattcccagggattttccccatcagtctgtcccttgggttttgcaagctactctgcacctgggctggcctcagttgaaggatcatgcagtagatagaggggaggcagggagagcttgtgggaccttcagtgctgactttagccaccatttccattcctatacaggatgtgaaggtcagaaggcagccaattgttggtttaattttttttttttttgagacagtctgtttcccaggctggagtgtagtgatacagtcacagctcactgtagcctcgaccttccaggctcaaaagatgctcccaccacagcctcccaggtagtgagtagctggtactacaggtgtgtgctgccacacccgactaatttttttgtagagacggggtttcgctgttcccaggctggtctcaaactcctgggctcaagtgaacctcccgcctcggcctcccaaagtgctgggattcctttctttatttctgtagaatctattttatggttggcattttgggggaagatttcgatgggttccacattcttgctttagttgttgtagagggatttgggtgtttctacccaaggcattggtctagcttttcctacaatgaacctatctttggaggttcaagctccccaccttcccccactgtggtgacctgtggccacttgcagaagggatggtgcctgacccactgccctagccccacgctatgcaccaaacttgttctccccgtcctggtccagggctggggtctttagagactgacagcctctgccccaggcctgagtccttagcaagggttgggtaaggaggttttaagggagaaggtccagtccttagcccttgaaatacaaagctcttctgacactgaatttggatgcaccttgttttatataataaatcgtgtttcacagaaaaaaaaaaaaaaaaaaaaaaaanncgttggtggggcgcggcactgggcccnggaaaagncttcaganacccatcggttgggngcgccggggggcccacaaaaagaaagttgagacatgtgcgtcgaacagcggtggaccatgagaagacaacccgggggcgaaagacacaacaggcgcgagagaatctcccacccggatacaaagaaggccgcgggtggaacccagcggaggagttttcggagacgn

SEQ ID NO: 32924 - DNA, 3955 bp, Homo sapiens
  misc_feature (3731)..(3732): n is a, c, g, or t
  misc_feature (3759)..(3759): n is a, c, g, or t
  misc_feature (3767)..(3767): n is a, c, g, or t
  misc_feature (3775)..(3775): n is a, c, g, or t
  misc_feature (3790)..(3790): n is a, c, g, or t
  misc_feature (3955)..(3955): n is a, c, g, or t
cagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtggccatggtggaggtgcagctggagagtgaccacgagtacccaccaggcctgctggtggccttcagtgcctgcaccaccgtgctggtggctgtgcacctctttgcactcatggtctccacgtgtctgctgccccacattgaagctgtgagcaacatccacaacctcaactctgtccaccagtcgccacaccagagactgcaccgctacgtggagctggcctggggcttctccactgccctgggcacctttctcttccttgctgaagttgtcctggttggttgggtcaagtttgtgcccattggggctcccttggacacaccgacccccatggtgcccacatcccgggtgcccgggactctggcaccagtggctacctcccttagtccagcttccaatctcccacggtcctctgcgtctgcagcaccgtcccaggctgagccagcctgcccaccccggcaagcctgtggtggtggtggggcccatgggccaggctggcaagcagccatggcctccacagccatcatggtacccgtggggctcgtgtttgtggcctttgccctgcatttctaccgctccttggtggcacacaagacagaccgctacaagcaggaactagaggaactgaatcgcctgcagggggagctgcaggctgtgtgagactggtgttagccaccgctcactgcaagcactgcctccctccggggtctgtaagaggccgcaggggcctacagacctcatccccccatcccctggctggagccacttccagtggccactctcaggcagagttcagattcctgcccgcagggtcctctgggctgggccttggggcagctcccacattcccagggattttccccatcagtctgtcccttgggttttgcaagctactctgcacctgggctggcctcagttgaaggatcatgcagtagatagaggggaggcagggagagcttgtgggaccttcagtgctgactttagccaccatttccattcctatacaggatgtgaaggtcagaaggcagccaattgttggtttaattttttttttttttgagacagtctgtttcccaggctggagtgtagtgatacagtcacagctcactgtagcctcgaccttccaggctcaaaagatgctcccaccacagcctcccaggtagtgagtagctggtactacaggtgtgtgctgccacacccgactaatttttttgtagagacggggtttcgctgttcccaggctggtctcaaactcctgggctcaagtgaacctcccgcctcggcctcccaaagtgctgggattcctttctttatttctgtagaatctattttatggttggcattttgggggaagatttcgatgggttccacattcttgctttagttgttgtagagggatttgggtgtttctacccaaggcattggtctagcttttcctacaatgaacctatctttggaggttcaagctccccaccttcccccactgtggtgacctgtggccacttgcagaagggatggtgcctgacccactgccctagccccacgctatgcaccaaacttgttctccccgtcctggtccagggctggggtctttagagactgacagcctctgccccaggcctgagtccttagcaagggttgggtaaggaggttttaagggagaaggtccagtccttagcccttgaaatacaaagctcttctgacactgaatttggatgcaccttgttttatataataaatcgtgtttcacagaaaaaaaaaaaaaaaaaaaaaaaanncgttggtggggcgcggcactgggcccnggaaaagncttcaganacccatcggttgggngcgccggggggcccacaaaaagaaagttgagacatgtgcgtcgaacagcggtggaccatgagaagacaacccgggggcgaaagacacaacaggcgcgagagaatctcccacccggatacaaagaaggccgcgggtggaacccagcggaggagttttcggagacgn

SEQ ID NO: 32925 - DNA, 1929 bp, Homo sapiens
  misc_feature (1705)..(1706): n is a, c, g, or t
  misc_feature (1733)..(1733): n is a, c, g, or t
  misc_feature (1741)..(1741): n is a, c, g, or t
  misc_feature (1749)..(1749): n is a, c, g, or t
  misc_feature (1764)..(1764): n is a, c, g, or t
  misc_feature (1929)..(1929): n is a, c, g, or t
gtggacggtcggatgtggatatgtgacagcgtcggcatcatggtctccacgtgtctgctgccccacattgaagctgtgagcaacatccacaacctcaactctgtccaccagtcgccacaccagagactgcaccgctacgtggagctggcctggggcttctccactgccctgggcacctttctcttccttgctgaagttgtcctggttggttgggtcaagtttgtgcccattggggctcccttggacacaccgacccccatggtgcccacatcccgggtgcccgggactctggcaccagtggctacctcccttagtccagcttccaatctcccacggtcctctgcgtctgcagcaccgtcccaggctgagccagcctgcccaccccggcaagcctgtggtggtggtggggcccatgggccaggctggcaagcagccatggcctccacagccatcatggtacccgtggggctcgtgtttgtggcctttgccctgcatttctaccgctccttggtggcacacaagacagaccgctacaagcaggaactagaggaactgaatcgcctgcagggggagctgcaggctgtgtgagactggtgttagccaccgctcactgcaagcactgcctccctccggggtctgtaagaggccgcaggggcctacagacctcatccccccatcccctggctggagccacttccagtggccactctcaggcagagttcagattcctgcccgcagggtcctctgggctgggccttggggcagctcccacattcccagggattttccccatcagtctgtcccttgggttttgcaagctactctgcacctgggctggcctcagttgaaggatcatgcagtagatagaggggaggcagggagagcttgtgggaccttcagtgctgactttagccaccatttccattcctatacaggatgtgaaggtcagaaggcagccaattgttggtttaattttttttttttttgagacagtctgtttcccaggctggagtgtagtgatacagtcacagctcactgtagcctcgaccttccaggctcaaaagatgctcccaccacagcctcccaggtagtgagtagctggtactacaggtgtgtgctgccacacccgactaatttttttgtagagacggggtttcgctgttcccaggctggtctcaaactcctgggctcaagtgaacctcccgcctcggcctcccaaagtgctgggattcctttctttatttctgtagaatctattttatggttggcattttgggggaagatttcgatgggttccacattcttgctttagttgttgtagagggatttgggtgtttctacccaaggcattggtctagcttttcctacaatgaacctatctttggaggttcaagctccccaccttcccccactgtggtgacctgtggccacttgcagaagggatggtgcctgacccactgccctagccccacgctatgcaccaaacttgttctccccgtcctggtccagggctggggtctttagagactgacagcctctgccccaggcctgagtccttagcaagggttgggtaaggaggttttaagggagaaggtccagtccttagcccttgaaatacaaagctcttctgacactgaatttggatgcaccttgttttatataataaatcgtgtttcacagaaaaaaaaaaaaaaaaaaaaaaaanncgttggtggggcgcggcactgggcccnggaaaagncttcaganacccatcggttgggngcgccggggggcccacaaaaagaaagttgagacatgtgcgtcgaacagcggtggaccatgagaagacaacccgggggcgaaagacacaacaggcgcgagagaatctcccacccggatacaaagaaggccgcgggtggaacccagcggaggagttttcggagacgn

SEQ ID NO: 32926 - DNA, 2169 bp, Homo sapiens
cagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccggg

SEQ ID NO: 32927 - DNA, 3492 bp, Homo sapiens
cagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccggggctgcggagttcgtgtgtgtatctgcggggtccctacctacagatgagtgggctcacctctcctggactcagggagggatttggaagtgtggacacctggggtgtccagctgtaccttggagggggctggggttggcgtgcacctcggtggggtccgggcgcttggataacgttcttggtgggtaggggtcgcggggaatctctgcgggcccgggactgcggggacttggtccccggctccaccccatcatgtggctagccccggctccgcctctgtcccagttcctgttttggcctccgctgtcccgctccggctcctggggctccccgcagacgctgcttttcttgctccactgggggtgcctcttcctgggcgcccgccgcctgcatcctgctcgccctgtctgggaatggggccgcccccgggcttgggccggcccggctggggcccccgaggcgcttccgccccgtagtgaccgcctggtgccgccccccccccaggatgaagggcggcgagggggacgcgggcgagcaggccccgctgaaccctgagggcgagagccctgcaggctcggccacgtaccgggagttcgtgcaccgcggctacctggacctcatgggggccagtcagcactcgctgcgggcgctcagctggcgccgcctctacctcagccgggccaagctcaaagcttccagccgcacgtctgccttgctctcgggcttcgccatggtggccatggtggaggtgcagctggagagtgaccacgagtacccaccaggcctgctggtggccttcagtgcctgcaccaccgtgctggtggctgtgcacctctttgcactcatggtctccacgtgtctgctgccccacattgaagctgtgagcaacatccacaacctcaactctgtccaccagtcgccacaccagagactgcaccgctacgtggagctggcctggggcttctccactgccctgggcacctttctcttccttgctgaagttgtcctgagataaggaaacaggcccaagaaggctgaagatcttgcccaaaaccacacagctagtccatgaaactgaacttggactatctacccctcacacgggaatctctctttgatttgagaaaaggaaccagtgcctttcaactggaacagaaaggaatctgatctcaacacctatgcctccacgtaaattatttttttcagccttatttccctcaaaattgtagagtcctaatcttcttctatcttgtggtgtgagaccttggataagtctcccttccaccttttcctattacttaaaatggtgaatttgcataaaccagg

SEQ ID NO: 32928 - DNA, 3216 bp, Homo sapiens
cagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccggggctgcggagttcgtgtgtgtatctgcggggtccctacctacagatgagtgggctcacctctcctggactcagggagggatttggaagtgtggacacctggggtgtccagctgtaccttggagggggctggggttggcgtgcacctcggtggggtccgggcgcttggataacgttcttggtgggtaggggtcgcggggaatctctgcgggcccgggactgcggggacttggtccccggctccaccccatcatgtggctagccccggctccgcctctgtcccagttcctgttttggcctccgctgtcccgctccggctcctggggctccccgcagacgctgcttttcttgctccactgggggtgcctcttcctgggcgcccgccgcctgcatcctgctcgccctgtctgggaatggggccgcccccgggcttgggccggcccggctggggcccccgaggcgcttccgccccgtagtgaccgcctggtgccgccccccccccaggatgaagggcggcgagggggacgcgggcgagcaggccccgctgaaccctgagggcgagagccctgcaggctcggccacgtaccgggagttcgtgcaccgcggctacctggacctcatgggggccagtcagcactcgctgcgggcgctcagctggcgccgcctctacctcagccgggccaagctcaaagcttccagccgcacgtctgccttgctctcgggcttcgccatgagataaggaaacaggcccaagaaggctgaagatcttgcccaaaaccacacagctagtccatgaaactgaacttggactatctacccctcacacgggaatctctctttgatttgagaaaaggaaccagtgcctttcaactggaacagaaaggaatctgatctcaacacctatgcctccacgtaaattatttttttcagccttatttccctcaaaattgtagagtcctaatcttcttctatcttgtggtgtgagaccttggataagtctcccttccaccttttcctattacttaaaatggtgaatttgcataaaccagg

SEQ ID NO: 32929 - DNA, 2312 bp, Homo sapiens
cagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccgggaaaagcaaagaacacaggaacaaaaaaaaggggggcgtaaatacaccggagagccgcgagacgcccgctgtgacggaggcccaaaaggagaaaaaaaagccgggcgcgacaaccgggagaagcggcgcgcgaccccccgggcc

SEQ ID NO: 32930 - DNA, 2271 bp, Homo sapiens
cagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcagagataaggaaacaggcccaagaaggctgaagatcttgcccaaaaccacacagctagtccatgaaactgaacttggactatctacccctcacacgggaatctctctttgatttgagaaaaggaaccagtgcctttcaactggaacagaaaggaatctgatctcaacacctatgcctccacgtaaattatttttttcagccttatttccctcaaaattgtagagtcctaatcttcttctatcttgtggtgtgagaccttggataagtctcccttccaccttttcctattacttaaaatggtgaatttgcataaaccagg

SEQ ID NO: 32931 - DNA, 1106 bp, Homo sapiens
cagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccacgggggacccagccgggctgggcccctgggccccgggtctgtacaatacggtttgctataaaactcaaaatcttccagccggg

SEQ ID NO: 32932 - DNA, 466 bp, Homo sapiens
aagtctttatcattttcatttcagagataaggaaacaggcccaagaaggctgaagatcttgcccaaaaccacacagctagtccatgaaactgaacttggactatctacccctcacacgggaatctctctttgatttgagaaaaggaaccagtgcctttcaactggaacagaaaggaatctgatctcaacacctatgcctccacgtaaattatttttttcagccttatttccctcaaaattgtagagtcctaatcttcttctatcttgtggtgtgagaccttggataagtctcccttccaccttttcctattacttaaaatggtgaatttgcataaaccaggctctaagggtcttttctgcactgttcggatgtgtacaaattgacatccaagtttaaaggaagactctgaaacttaggtcaatgacttgcccaaggccatatagcgagggcctgatgtacacatat

SEQ ID NO: 32933 - DNA, 2682 bp, Homo sapiens
cccgcctcttcctcccttccttctttccttgctttcgccgcgcactccgccgccatggagcagcgccgcgtcaccgacttcttcgcgcgccgccgccccgggcccccccgcatcgcgccgcccaagctggcctgccgcacccccagccccgccaggcccgcactccgcgccccggcctccgctaccagtggcagccgcaagcgcgcccgcccgcccgccgcccccggacgcgaccaggccaggccaccggcccgcaggagactgcggctgtcggtggacgaggtttccagccccagtacccccgaggccccagacatcccagcctgcccttctccgggccagaagataaagaaatccaccccggcagcaggtcagccgccccacctgacatccgcgcaggaccaggacaccatctctgagcttgcgtcatgcctgcaacgggcccgggagctgggggcaagagtccgggcgctgaaggccagtgcccaggatgctggggagtcctgcaccccagaggccgagggccgccctgaggagccatgtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggcgttttgaggagcgcaatgttggccagatcaaaaccgtgtacccggcctcctaccgcttccgccaggagcgcagtgtccccaccttcaaggatggcgccaggaggtcagattaccagctcaccatcgagccactgctggagcaggaggctgacggagcagccccccagctcacggcctcgcgcctcctgcagcgacggcagatcttcagccagaagctggtggagcacgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggggaaatggagaagcacctgctgctcctctccgagctgctgccggactggctcagcctccaccgcatccgcaccgacacctacgtcaagctggacaaggccgcggacctggcccacatcactgcacgcctggcccaccagacacgtgctgaggaggggctgtgagcctgggggccactgtggacagacgtgggcttcagaagctcgctggcctgggcccaccagcattttcttttatgaacatgatacactttggtcttcctttccccagcgcccctgagggccagaggcagatgtgggctgcaggctgcacagcccgagggtctctggctgcgggcggtgggccccttcatggggctcacctggtggattcacattaaaccggtttctgtgggcacctctgtccttgctgctggtggggaagggaagccagatccagcaccccctggggggccatcgggagtgtggctgggggtgaagggggctctgtggcaatatggggttgggtagtgtgggtggcaggccatcccctctaatcttggaacctctgaatatgggacctcccacagcaaagggtgacttttgtcattaagaaagactggggtgggtgtggtggctcacgcctgtaaccccagcactttgggaggccaaggtgggcagatcacgaggtcaagagatcgagaccatcctggcgaacatggtgaaaccccatctctactaaaaatacaaaaaattagccgggtgtggtggtgggcacctgtcgtcccagctactagggaggctgaggcaggagaatggtgtgaacccaggaggcacagcttgcagtgagcgaagatcgcaccactgcacgcactccagcctgggtgacagagcgagactccgtctcaaaaaaaaaaatttcaagactggagaggtgatcctgaattgtccagctacgccccatgtcatcacagggccttcatgacagggccagagccagccagctttgaagacgcggccctgccccgacacaggcagcctggagaagctgggcaggacaagtaggacatccctggagcctccagaagggactggcctctgcccacaccttgacttcagtatttctgacctcctaaactctaataaagtcatgcttacagccactagatctgc

SEQ ID NO: 32934 - DNA, 314 bp, Homo sapiens
ggggttatggatatcgtcgacccacgcggtccgcatcactgcacgcctggcccaccagacacgtgctgaggaggggctgtgagcctgggggccactgtggacagacgtgggcttcagaagctcgctggcctgggcccaccagcattttcttttatgaacatgatacactttggtcttcctttccccagcgcccctgagggccagaggcagatgtgggctgcaggctgcacagcccgagggtctctggctgcgggcggtgggccccttcatggggctcacctggtggattcacattaaaccggtttctgtgggca

SEQ ID NO: 32935 - DNA, 1964 bp, Homo sapiens
taaaccaacaacaacacaaaaacacaacaaaaccaaaaacttacggctaggtacgaggctgggtgttgctttcgccgcgcactccgccgccatggagcagcgccgcgtcaccgacttcttcgcgcgccgccgccccgggcccccccgcatcgcgccgcccaagctggcctgccgcacccccagccccgccaggcccgcactccgcgccccggcctccgctaccagtggcagccgcaagcgcgcccgcccgcccgccgcccccggacgcgaccaggccaggccaccggcccgcaggagactgcggctgtcggtggacgaggtttccagccccagtacccccgaggccccagacatcccagcctgcccttctccgggccagaagataaagaaatccaccccggcagcaggtcagccgccccacctgacatccgcgcaggaccaggacaccatctctgagcttgcgtcatgcctgcaacgggcccgggagctgggggcaagagtccgggcgctgaaggccagtgcccaggatgctggggagtcctgcaccccagaggccgagggccgccctgaggagccatgtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggcgttttgaggagcgcaatgttggccagatcaaaaccgtgtacccggcctcctaccgcttccgccaggagcgcagtgtccccaccttcaaggatggcgccaggaggtcagattaccagctcaccatcgagccactgctggagcaggaggctgacggagcagccccccagctcacggcctcgcgcctcctgcagcgacggcagatcttcagccagaagctggtggagcacgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggggaaatggagaagcacctgctgctcctctccgagctgctgccggactggctcagcctccaccgcatccgcaccgacacctacgtcaagctggacaaggccgcggacctggcccacatcactgcacgcctggcccaccagacacgtgctgaggaggggctgtgagcctgggggccactgtggacagacgtgggcttcagaagctcgctggcctgggcccaccagcattttcttttatgaacatgatacactttggtcttcctttccccagcgcccctgagggccagaggcagatgtgggctgcaggctgcacagcccgagggtctctggctgcgggcggtgggccccttcatggggctcacctggtggattcacattaaaccggtttctgtgggca

SEQ ID NO: 32936 - DNA, 2221 bp, Homo sapiens
taaaccaacaacaacacaaaaacacaacaaaaccaaaaacttacggctaggtacgaggctgggtgttgctttcgccgcgcactccgccgccatggagcagcgccgcgtcaccgacttcttcgcgcgccgccgccccgggcccccccgcatcgcgccgcccaagctggcctgccgcacccccagccccgccaggcccgcactccgcgccccggcctccgctaccagtggcagccgcaagcgcgcccgcccgcccgccgcccccggacgcgaccaggccaggccaccggcccgcaggagactgcggctgtcggtggacgaggtttccagccccagtacccccgaggccccagacatcccagcctgcccttctccgggccagaagataaagaaatccaccccggcagcaggtcagccgccccacctgacatccgcgcaggaccaggacaccatctctgagcttgcgtcatgcctgcaacgggcccgggagctgggggcaagagtccgggcgctgaaggccagtgcccaggatgctggggagtcctgcaccccagaggccgagggccgccctgaggagccatgtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggcgttttgaggagcgcaatgttggccagatcaaaaccgtgtacccggcctcctaccgcttccgccaggagcgcagtgtccccaccttcaaggatggcgccaggaggtcagattaccagctcaccatcgagccactgctggagcaggaggctgacggagcagccccccagctcacggcctcgcgcctcctgcagcgacggcagatcttcagccagaagctggtggagcacgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggggaaatggagaagcacctgctgctcctctccgagctgctgccggactggctcagcctccaccgcatccgcaccgacacctacgtcaagctggacaaggccgcggacctggcccacatcactgcacgcctggcccaccagacacgtgctgaggaggggctgtgagcctgggggccactgtggacagacgtgggcttcagaagctcgctggcctgggcccaccagcattttcttttatgaacatgatacactttggtcttcctttccccagcgcccctgagggccagaggcagatgtgggctgcaggctgcacagcccgagggtctctggctgcgggcggtgggccccttcatggggctcacctggtggattcacattaaaccggtttctgtgggcaaaaaaaaaagagaaagatcatccacagccacacggcagaagacaagaaggagcagaacagaaaaagaaggggggggcgcagacaagcacccggagggccgccaatgtgaaggcacaccagctgcggcaacagggggccccatagggcgggcatatataacaacgacggcgggcgcgcgttaacacacgcgcgacgcggaaaaggaagaggggaacatcgggaaaaacaccccagggggggcacaacagggaacaccc

SEQ ID NO: 32937 - DNA, 1871 bp, Homo sapiens
tcagctggtaccccccgggtatgggatatgtcgaccacgccgtcggctcaccatcgagcctcttgctggagcaggaggctgacggagcagccccccagctcacggcctcgcgcctcctgcagcgacggcagatcttcagccagaagctggtggagcacgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggggaaatggagaagcacctgctgctcctctccgagctgctgccggactggctcagcctccaccgcatccgcaccgacacctacgtcaagctggacaaggccgcggacctggcccacatcactgcacgcctggcccaccagacacgtgctgaggaggggctgtgagcctgggggccactgtggacagacgtgggcttcagaagctcgctggcctgggcccaccagcattttcttttatgaacatgatacactttggtcttcctttccccagcgcccctgagggccagaggcagatgtgggctgcaggctgcacagcccgagggtctctggctgcgggcggtgggccccttcatggggctcacctggtggattcacattaaaccggtttctgtgggcacctctgtccttgctgctggtggggaagggaagccagatccagcaccccctggggggccatcgggagtgtggctgggggtgaagggggctctgtggcaatatggggttgggtagtgtgggtggcaggccatcccctctaatcttggaacctctgaatatgggacctcccacagcaaagggtgacttttgtcattaagaaagactggggtgggtgtggtggctcacgcctgtaaccccagcactttgggaggccaaggtgggcagatcacgaggtcaagagatcgagaccatcctggcgaacatggtgaaaccccatctctactaaaaatacaaaaaattagccgggtgtggtggtgggcacctgtcgtcccagctactagggaggctgaggcaggagaatggtgtgaacccaggaggcacagcttgcagtgagcgaagatcgcaccactgcacgcactccagcctgggtgacagagcgagactccgtctcaaaaaaaaaaatttcaagactggagaggtgatcctgaattgtccagctacgccccatgtcatcacagggccttcatgacagggccagagccagccagctttgaagacgcggccctgccccgacacaggcagcctggagaagctgggcaggacaagtaggacatccctggagcctccagaagggactggcctctgcccacaccttgacttcagtatttctgacctcctaaactctaataaagtcatgcttacagccactagatctgc

SEQ ID NO: 32938 - DNA, 273 bp, Homo sapiens
gaatgggttacaagtatgggtaggaattactgctatctgatataactattggtgggtgatggtattcttcaaattcagagaaaggcctcgctaaaacacacacacacactcatgtgctatttcattgcaaactgtttttgtggacctggacttgttgagaacctgttcaatgacagggtggaaatgcaaagcttggtattgtgtgctgtggttggtgttcaggagtcaatcatttccagggctacttaatgtctatttaaccaccagatgcca

SEQ ID NO: 32939 - DNA, 345 bp, Homo sapiens
gtgacttcttaattccttttccatggtctctgaaatattttctcttctaagctccagtatgaagtttaagtattccaatacatgcttctgctttctgggtccaagacatattgagaaggccatctcagctgtcccagggtcctaaccttattcaataaaatactttgtactagctctcttataatttagtaagatattctataccatagttattctatctgtatgaggacagggtataagacgcattctcttttctataggaaaggtttgtggccttaatgaatttgctttaatttaatttaatctgcaatcttcaattcttttacccctccttttttccttagc

SEQ ID NO: 32940 - DNA, 543 bp, Homo sapiens
ggatttaccgggagctggagccttcacatatattgattctaagccttatgtcagcattgcaagatagattaggaagaacaaagaactatattagtagtttaaaataatggctttaaactgctttacaccttgtttatcaaatcaagtgagcccttgaaatttaatcagggactggacggtagggggcacccatggtacttatgttgctctggctatgttgagagcgtcttaagtcataaacacagatttgttgaatgagtttgatactttgaaaattatcacctagaggctgggtgcggtggctcacgcctgtaatcccagcactttgggagactgaggcaggtggatcgcgtgaggtcaggagtttgagaccagcctggccaacatggtgaaacctcatctctactaaaaatagaaaaattatccgggtgtggtggtaggtgcctgtaatcccaactattcaggaggctgaggcaggagaattgcttgacgctgggaggtggaagttgcagtgagctgagattgcgccattgtagtccagcc

SEQ ID NO: 32941 - DNA, 2422 bp, Homo sapiens
agcgggctcggctcgcggggactggcctccttcggcagctggaggcggtcactcacgctgggctaggagctgaggcgagaagggccatgcggacggcgagggagtccagagccttgagcccggtgctcctccctcgcgcagcggtggctctgcggccgctggagtaaacactgcctttgttccctagcgcctcgtctttcgtcgccccgtgccctcacgccgccgggctctggccggcccgccctcggtccttgaaccccatttcggctcgtgccgtgcggatgcagctgccgggcctgggtttgggcattgagcgggaggaggaggaggagcggcggcgcctgggcggcatgcgatggggaactgctgctggacgcagtgcttcggactgcttcgcaaggaagcggggcggctgcagcgagtaggcggcggcggaggatccaagtattttagaacatgctcaagaggtgagcacttaacaatagagtttgagaatctagtagaaagtgatgaaggggagagcccaggaagcagtcataggcctcttactgaggaagaaattgttgacctaagagaaaggcattatgattccattgccgaaaaacaaaaagatcttgataagaaaattcaaaaagagcaagaaaggcagagaattgtgcagcaatatcatccttccaacaatggagaatatcaaagttcaggaccagaagatgacttcgaatcttgtttgagaaatatgaagtcacagtatgaagtttttcgaagtagtagactctcatcagatgctacagttttgacaccaaatacagaaagcagttgtgatttaatgaccaaaactaaatcaactagtggaaatgacgacagcacatccttagatctagagtgggaagatgaagaaggaatgaatagaatgcttccaatgagagaacgttccaaaacagaggaagacattctacgggcagcacttaagtatagcaacaagaagactggaagtaatcctacatcagcctctgatgattccaatgggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggatgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaactatgaaaatattaagacttttttgttaattctcagccgatgtgaaggaagcatgaggagggatcgtcagattcagatttagaatagtgttcccgtttccagcattatttatttctatgacttctttggattttattatctaatagtaagtacagttgatgtgggtagatgactctaagaaatgctgaagtatcggcattacatgtgtttatttacatgtcctagtatgataatgttgattcaatctgaacaaaagataatataaaaataacccttcagagtttggacatttcaagttggtaataataaaaaataatatttaagaagatatatatatatatatatttagttttttccacttcattttacatgccactatattgactttaattgatatacagtattaagtttttaggtgccattatttttaaaaaattctatatttccaatgaacgatgttagattttacacagaacatattctctgcatgatttcagaaaagaaaatctaaaaaggtaatacgggtatttcaaataaaatcctttctggtatgaaaggctccattgattttattaagccttcctttaccttgtagtacaaggtgctttaatgggatagaactaagcatatcaatatctataactgcattttgtgctagacaattactgttcttttctctaaaatgtatatgtcaatttacaaggccagggatagaaaacactccataattgctttccttgattttgctgaggatttggtatgattttagtaagcaaactgttttttggtttttccttaatgtttttaattttttttcctcttgcaacaatgacggtgcatgttcttataaatataggaaggtccagatataaatagtaacctaaagttcttgctgtgctt

SEQ ID NO: 32942 - DNA, 2361 bp, Homo sapiens
agcgggctcggctcgcggggactggcctccttcggcagctggaggcggtcactcacgctgggctaggagctgaggcgagaaggtggctctgcggccgctggagtaaacactgcctttgttccctagcgcctcgtctttcgtcgccccgtgccctcacgccgccgggctctggccggcccgccctcggtccttgaaccccatttcggctcgtgccgtgcggatgcagctgccgggcctgggtttgggcattgagcgggaggaggaggaggagcggcggcgcctgggcggcatgcgatggggaactgctgctggacgcagtgcttcggactgcttcgcaaggaagcggggcggctgcagcgagtaggcggcggcggaggatccaagtattttagaacatgctcaagaggtgagcacttaacaatagagtttgagaatctagtagaaagtgatgaaggggagagcccaggaagcagtcataggcctcttactgaggaagaaattgttgacctaagagaaaggcattatgattccattgccgaaaaacaaaaagatcttgataagaaaattcaaaaagagcaagaaaggcagagaattgtgcagcaatatcatccttccaacaatggagaatatcaaagttcaggaccagaagatgacttcgaatcttgtttgagaaatatgaagtcacagtatgaagtttttcgaagtagtagactctcatcagatgctacagttttgacaccaaatacagaaagcagttgtgatttaatgaccaaaactaaatcaactagtggaaatgacgacagcacatccttagatctagagtgggaagatgaagaaggaatgaatagaatgcttccaatgagagaacgttccaaaacagaggaagacattctacgggcagcacttaagtatagcaacaagaagactggaagtaatcctacatcagcctctgatgattccaatgggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggatgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaactatgaaaatattaagacttttttgttaattctcagccgatgtgaaggaagcatgaggagggatcgtcagattcagatttagaatagtgttcccgtttccagcattatttatttctatgacttctttggattttattatctaatagtaagtacagttgatgtgggtagatgactctaagaaatgctgaagtatcggcattacatgtgtttatttacatgtcctagtatgataatgttgattcaatctgaacaaaagataatataaaaataacccttcagagtttggacatttcaagttggtaataataaaaaataatatttaagaagatatatatatatatatatttagttttttccacttcattttacatgccactatattgactttaattgatatacagtattaagtttttaggtgccattatttttaaaaaattctatatttccaatgaacgatgttagattttacacagaacatattctctgcatgatttcagaaaagaaaatctaaaaaggtaatacgggtatttcaaataaaatcctttctggtatgaaaggctccattgattttattaagccttcctttaccttgtagtacaaggtgctttaatgggatagaactaagcatatcaatatctataactgcattttgtgctagacaattactgttcttttctctaaaatgtatatgtcaatttacaaggccagggatagaaaacactccataattgctttccttgattttgctgaggatttggtatgattttagtaagcaaactgttttttggtttttccttaatgtttttaattttttttcctcttgcaacaatgacggtgcatgttcttataaatataggaaggtccagatataaatagtaacctaaagttcttgctgtgctt

SEQ ID NO: 32943 - DNA, 1124 bp, Homo sapiens
agcgggctcggctcgcggggactggcctccttcggcagctggaggcggtcactcacgctgggctaggagctgaggcgagaagggccatgcggacggcgagggagtccagagccttgagcccggtgctcctccctcgcgcagcggtggctctgcggccgctggagtaaacactgcctttgttccctagcgcctcgtctttcgtcgccccgtgccctcacgccgccgggctctggccggcccgccctcggtccttgaaccccatttcggctcgtgccgtgcggatgcagctgccgggcctgggtttgggcattgagcgggaggaggaggaggagcggcggcgcctgggcggcatgcgatggggaactgctgctggacgcagtgcttcggactgcttcgcaaggaagcggggcggctgcagcgagtaggcggcggcggaggatccaagtattttagaacatgctcaagaggtgagcacttaacaatagagtttgagaatctagtagaaagtgatgaaggggagagcccaggaagcagtcataggcctcttactgaggaagaaattgttgacctaagagaaaggcattatgattccattgccgaaaaacaaaaagatcttgataagaaaattcaaaaagagttagccttacaagaagagaagttaagactagaagaagaagctttatacgctgcacagcgtgaagcagccagggcagcaaagcagcgaaagctcttggagcaagaaaggcagagaattgtgcagcaatatcatccttccaacaatggagaatatcaaagttcaggaccagaagatgacttcgaatcttgtttgagaaatatgaagtcacagtatgaagtttttcgaagtagtagactctcatcagatgctacagttttgacaccaaatacagaaagcagttgtgatttaatgaccaaaactaaatcaactagtggaaatgacgacagcacatccttagatctagagtgggaagatgaagaaggtattttataattcacaattttacctgaaaaatttaacgtaatctgtgttgatttatgtaaatctaccttggtctttatttaaatggaaataaattcaaggccttgaaaaatcatataaacacttt

SEQ ID NO: 32944 - DNA, 686 bp, Homo sapiens
agcgggctcggctcgcggggactggcctccttcggcagctggaggcggtcactcacgctgggctaggagctgaggcgagaagggccatgcggacggcgagggagtccagagccttgagcccggtgctcctccctcgcgcagcggtggctctgcggccgctggagtaaacactgcctttgttccctagcgcctcgtctttcgtcgccccgtgccctcacgccgccgggctctggccggcccgccctcggtccttgaaccccatttcggctcgtgccgtgcggatgcagctgccgggcctgggtttgggcattgagcgggaggaggaggaggagcggcggcgcctgggcggcatgcgatggggaactgctgctggacgcagtgcttcggactgcttcgcaaggaagcggggcggctgcagcgagtaggcggcggcggaggatccaagtattttagaacatgctcaagaggtgagcacttaacaatagagtttgagaatctagtagaaagtgatgaaggggagagcccaggaagcagtcatagtttagcaaacatttattaagcaactgtcgtgtgccaagcaccgtgctagacactgggattttaaaaatcagacatagtctctccattagaagaaagaacatcctggtctgggagatagattctcgagatgactaatttcaatatga

SEQ ID NO: 32945 - DNA, 542 bp, Homo sapiens
agcgggctcggctcgcggggactggcctccttcggcagctggaggcggtcactcacgctgggctaggagctgaggcgagaagggccatgcggacggcgagggagtccagagccttgagcccggtgctcctccctcgcgcagcggtggctctgcggccgctggagtaaacactgcctttgttccctagcgcctcgtctttcgtcgccccgtgccctcacgccgccgggctctggccggcccgccctcggtccttgaaccccatttcggctcgtgccgtgcggatgcagctgccgggcctgggtttgggcattgagcgggaggaggaggaggagcggcggcgcctgggcggcatgcgatggggaactgctgctggacgcagtgcttcggactgcttcgcaaggaagcggggcggctgcagcgagtaggcggcggcggaggatccaagtattttagaacatgctcaagaggtgagcacttaacaatagaggtaagtagtccttaatttgattgaattaaaaatgccttcagaaaggcggaagggg

SEQ ID NO: 32946 - DNA, 2913 bp, Homo sapiens
agcgggctcggctcgcggggactggcctccttcggcagctggaggcggtcactcacgctgggctaggagctgaggcgagaagggccatgcggacggcgagggagtccagagccttgagcccggtgctcctccctcgcgcagcggtggctctgcggccgctggagtaaacactgcctttgttccctagcgcctcgtctttcgtcgccccgtgccctcacgccgccgggctctggccggcccgccctcggtccttgaaccccatttcggctcgtgccgtgcggatgcagctgccgggcctgggtttgggcattgagcgggaggaggaggaggagcggcggcgcctgggcggcatgcgatggggaactgctgctggacgcagtgcttcggactgcttcgcaaggaagcggggcggctgcagcgagtaggcggcggcggaggatccaagtattttagaacatgctcaagaggtgagcacttaacaatagagtttgagaatctagtagaaagtgatgaaggggagagcccaggaagcagtcataggcctcttactgaggaagaaattgttgacctaagagaaaggcattatgattccattgccgaaaaacaaaaagatcttgataagaaaattcaaaaagagttagccttacaagaagagaagttaagactagaagaagaagctttatacgctgcacagcgtgaagcagccagggcagcaaagcagcgaaagctcttggagcaagaaaggcagagaattgtgcagcaatatcatccttccaacaatggagaatatcaaagttcaggaccagaagatgacttcgaatcttgtttgagaaatatgaagtcacagtatgaagtttttcgaagtagtagactctcatcagatgctacagttttgacaccaaatacagaaagcagttgtgatttaatgaccaaaactaaatcaactagtggaaatgacgacagcacatccttagatctagagtgggaagatgaagaaggaatgaatagaatgcttccaatgagagaacgttccaaaacagaggaagacattctacgggcagcacttaagtatagcaacaagaagactggaagtaatcctacatcagcctctgatgattccaatgggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggatgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaactatgaaaatattaagacttttttgttaattctcagccgatgtgaaggaagcatgaggagggatcgtcagattcagatttagaatagtgttcccgtttccagcattatttatttctatgacttctttggattttattatctaatagtaagtacagttgatgtgggtagatgactctaagaaatgctgaagtatcggcattacatgtgtttatttacatgtcctagtatgataatgttgattcaatctgaacaaaagataatataaaaataacccttcagagtttggacatttcaagttggtaataataaaaaataatatttaagaagatatatatatatatatatttagttttttccacttcattttacatgccactatattgactttaattgatatacagtattaagtttttaggtgccattatttttaaaaaattctatatttccaatgaacgatgttagattttacacagaacatattctctgcatgatttcagaaaagaaaatctaaaaaggtaatacgggtatttcaaataaaatcctttctggtatgaaaggctccattgattttattaagccttcctttaccttgtagtacaaggtgctttaatgggatagaactaagcatatcaatatctataactgcattttgtgctagacaattactgttcttttctctaaaatgtatatgtcaatttacaaggccagggatagaaaacactccataattgctttccttgattttgctgaggatttggtatgattttagtaagcaaactgttttttggtttttccttaatgtttttaattttttttcctcttgcaacaatgacggtgcatgttcttataaatataggaaggtccagatataaatagtaacctaaagttcttgctgtgcttaaaaaaaaaaatcatgtggccctttcaatatttgaactgctaagcaatgacatctgtagttttatctccttttttatgtcatagaaattaatatgatactttaaatatgtaaatataatacattaggtaatgctattatttatatctgtcttaacataatttaagttgtagctgtgtcttggaaatatttttaaggtaatctatattcacattgcctgtgttaatgctttttaaagtttgtatacatcagatgtatatttttggtttggcataagctacgattgtaatttttcttggctttttgttcataaagaattttttgaaggaatggtaacaaatggtaatttacaaatggttgtgaataaacacatttttacacttaaaggtaaaaa

SEQ ID NO: 32947 - DNA, 2604 bp, Homo sapiens
agcgggctcggctcgcggggactggcctccttcggcagctggaggcggtcactcacgctgggctaggagctgaggcgagaagggccatgcggacggcgagggagtccagagccttgagcccggtgctcctccctcgcgcagcggtggctctgcggccgctggagtaaacactgcctttgttccctagcgcctcgtctttcgtcgccccgtgccctcacgccgccgggctctggccggcccgccctcggtccttgaaccccatttcggctcgtgccgtgcggatgcagctgccgggcctgggtttgggcatttgatgctgtggatgtgagtgatgtgatgtgatgctgtgctgtgcttgccttgtggctgtgtcattgcctgattggtgtgacacttgcttgctgtgactgcatgttgcttcgtgacttgcttctgcaatggaatgctggggctgtgctgcagctgagtagtgctggctgtgctgtgatgtgatccaagtgtagttttaagaagcagttgctccaaggatgtgttgatgcacttaagcaatatgagttttgacgaatctaggtagaaatgtgattgaagtgtgtgatgatgcccatgtgaatgcatgtcatatggcctcttactgaggaagaaattgttgacctaagagaaaggcattatgattccattgccgaaaaacaaaaagatcttgataagaaaattcaaaaagagttagccttacaagaagagaagttaagactagaagaagaagctttatacgctgcacagcgtgaagcagccagggcagcaaagcagcgaaagctcttggagcaagaaaggcagagaattgtgcagcaatatcatccttccaacaatggagaatatcaaagttcaggaccagaagatgacttcgaatcttgtttgagaaatatgaagtcacagtatgaagtttttcgaagtagtagactctcatcagatgctacagttttgacaccaaatacagaaagcagttgtgatttaatgaccaaaactaaatcaactagtggaaatgacgacagcacatccttagatctagagtgggaagatgaagaaggaatgaatagaatgcttccaatgagagaacgttccaaaacagaggaagacattctacgggcagcacttaagtatagcaacaagaagactggaagtaatcctacatcagcctctgatgattccaatgggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggatgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaactatgaaaatattaagacttttttgttaattctcagccgatgtgaaggaagcatgaggagggatcgtcagattcagatttagaatagtgttcccgtttccagcattatttatttctatgacttctttggattttattatctaatagtaagtacagttgatgtgggtagatgactctaagaaatgctgaagtatcggcattacatgtgtttatttacatgtcctagtatgataatgttgattcaatctgaacaaaagataatataaaaataacccttcagagtttggacatttcaagttggtaataataaaaaataatatttaagaagatatatatatatatatatttagttttttccacttcattttacatgccactatattgactttaattgatatacagtattaagtttttaggtgccattatttttaaaaaattctatatttccaatgaacgatgttagattttacacagaacatattctctgcatgatttcagaaaagaaaatctaaaaaggtaatacgggtatttcaaataaaatcctttctggtatgaaaggctccattgattttattaagccttcctttaccttgtagtacaaggtgctttaatgggatagaactaagcatatcaatatctataactgcattttgtgctagacaattactgttcttttctctaaaatgtatatgtcaatttacaaggccagggatagaaaacactccataattgctttccttgattttgctgaggatttggtatgattttagtaagcaaactgttttttggtttttccttaatgtttttaattttttttcctcttgcaacaatgacggtgcatgttcttataaatataggaaggtccagatataaatagtaacctaaagttcttgctgtgctt

SEQ ID NO: 32948 - DNA, 2138 bp, Homo sapiens
  misc_feature (950)..(950): n is a, c, g, or t
  misc_feature (1379)..(1379): n is a, c, g, or t
  misc_feature (1566)..(1566): n is a, c, g, or t
gaaattagggctcagggaagtctggtggggaaagcacagagctgtttaaatagaattgtagtgtccagagtaagggaagtgaaagcctcacttctctcccatgtgcttggagtaggatgtagactcttcaggtctggccaccctactatacggggagacattgacacagcagttccaaagagagcagccagggaggtaaaaaggccaatccccacttttttttttttttttttagagaagaccaagacaaagaaaaaggataattgatttggaaaagacttgaagagggatcggtgtctttacctaattaaaagatttgctcaggaaagagaaattagaccaactctgtcgttttggaagtagaatctagggccagcgggtgggagatgagaacacatggagctgggaataaaacgggcagcttcctcaatggtgagcaaagccaagggaagcagggctggggaagtgctgctgaggaaacctcaaggattggaccggatggcctccgagtcccttcccactctcagagtctgtgatcctaatcaggggactcaacagaaacttaagggaaaccccctgacttctcgactcgatgtatctattggagctggatttttacaccccgtgttagcagtaacagattggcaaagcaatagaaaacaaatgcaccaattcatgtttttcagaaacttaacaaaagttagcccctgaagtcatttctgtgttatgtgtgtggaggaacactgccggaggaccctgaccagctctgccaactcttttttttctttttttggatctcactctgtcatccaggctggagtgcagtggcacaatcacggctcacggcctcaacctcccaaagtgctgggattacaggtgtgagccacacagcacccagcccgtgctggtcttgacctcccaggctcaagccttccaagaggctgggactncaggcatgtgcccccatgcctggctaactttaacttttgtagagacgaggtcctgctgtgttgccagtgctggtcttgaactcctgggcccaagcgatcctcctgcctcagcctcgtgagccaccacatcgggcaagccctgccaactctttcctgacctgaggcagggctgaatgtaggaggttagggaattagaaacctaagggttgtcttgtttaattattattccggctatgtggagatctgagccattttccgttgtaagggtccttctggttgatgtgtatatgttgtggtttttgctttttttttttttttttggcaggtgtgcgagggacattttgagattgttccaattcattgtcatgattgagggattatgattaggattctgtaaagtaactagtccaggccaggtgtggtggctcncgcctgtaatcccagcactttgggaggctgagctgggtggatcgcctgaagtcaggagttcaagaccagcctggccaacatggtgaaacctatctctactaaaaatacaaaaattagccgggtgtggtggcacgtgcctgtaatcccagctactcgggaggctgaagcaggagaatcacttcagccngggaggcggaggttgcagtgagccaagatcctgccactgcactcgcgtctgggcgacagagtgagactccatctcagaaataaaaatttaaaaaaaaattagtccagaaaaacatctcacagctgaagtggtctcatgggaagggagaacagcactgcccaataggaatgctataatgggagccatagatctaaaatcaaattttagattttccaggagccacattaaaagaagtaaaaagaagcagataatatgaatttaaagaatgtattttatgccaggtgtggtggctctcgcctgtaatcccagcactttggggagccgaggtgggcggatcacttgaggtcaggagtttgagaccagcctggccaacatggtgaaaccccaactctactaaaaatacaaaaaactagccaggcgtggtagcttgtgcctgtaaccccagctactcgggagactgaagcaggagaatcgcttcagcgatttaggagaaccaggaggcagaggttgtggtgagttgagatcatgccactgtactccagcctgggtgacagagcaagactctgtctcaa

SEQ ID NO: 32949 - DNA, 493 bp, Homo sapiens
aatctaaagcatggccaggcatggtggctcacgcctgtaatcccagcgctttggaaggctgaggcaggaggatctcttgaagccaggagtttgagaccagcctgggcaacatagtgagacactgtctctattttttttcaagaagttaaaacaaacaaacaaacaaaaaaaccttattgcaccttaaagatttctaggctgagcgcagtggctcacacctgtaatcccagcactttgggaggctgaagtgggcggatcacttgaggtcaggagtttgagaccagcctggccaacatggtgaaaccccaactctactaaaaatacaaaaaactagccaggcgtggtagcttgtgcctgtaaccccagctactcgggagactgaagcaggagaatcgcttcagcgatttaggagaaccaggaggcagaggttgtggtgagttgagatcatgccactgtactccagcctgggtgacagagcaagactctgtctcaa

SEQ ID NO: 32950 - DNA, 257 bp, Homo sapiens
tttatttatttatttatttatttttatttttgagacagtttcgctcctgttgcccaggctggagtgcaatggcagtgagccaagactgtgtcactgtacttcagcctgggcgatagaacaagactccacctcaaaaatatatgtatatattaaaaattaaccaggtgtggtgttgtgcgccatagccccagctacacaggaggctgaggcaggaagattgcttgagcccaggaagtggagtttgcagtgagccaaga

SEQ ID NO: 32951 - DNA, 734 bp, Homo sapiens
ctgagataaaccccacttggttgtggtgcattgtcctttggaatattgctagagttgatttctaggtttttttttttttttttaagatttctatattggtgttgatggagatattggacttttgtatccttttcttgtaatgtctttatttgattttggtgtcaaggtgatattgggtgtcataaaattagatgggaagtgctgtctccttccctgtttttggaaatagctgtgtaagataggtatgatttcttctttacatgtttgataggatttaccagtgaagtcatctgaacctagagggttttgtttggtttggttttagttttttgtgggagaattaagattttttaagagatattttcagatttttctgttgtcagttttggtaatttgtgtcttttaggaaaatttcatttcatccaagttgttggatttattggcataaaatttttcagaatattcctttaatatccttctaatgtctgtagaatctaatctgtattgcagtctcttcatattggtaatttgtgttttttctattttttcctggatcagtcagtctagctggagatttatcaattctttataagatcacttattttagatcattaatgatcttttagtacaggggtattcactcttttagcttccctgggccacaacggaaggagaagaattgtcttgggccacacataggatacattaacgataagctgatgagccaaaaaaaa

SEQ ID NO: 32952 - DNA, 309 bp, Homo sapiens
ccaaagtgcagggattagagatgtgagccatcacacgtggccttagaccttttacgtttattttcatctgtaaattatcctatcatcctatttcattgaataaatgaaataatttatttcataatacaaggtttctcaacttcagcacttattggcattttgaacaggacaattcttgactgtgggggactgtcgtgtacattgtaggatgtttaggagcatccctggtatctactcatcagatgccagtagcacctcctcttcagtcgtgacaagggaaatcctctccagaacttaccaaatgtctcc

SEQ ID NO: 32953 - DNA, 398 bp, Homo sapiens
aggctgaaagatgggaggtaaggagagataaaggcctttttaaaggataaggagacgaaggtagggggaggtgaaagtgtactaaatgttttatcttcctggcattggaaaaaaatggggaagaaatagaacattttgatagaggccacatttgatatgctattttaagtaaatagtaaagaaatatgtgtattagaagaaaggaaaaatagcaaacagcaatacaaaataaatagtaaatataaagcaagctgtaaaacaaaataaaacgtgatactttatattatatttgaatggactgatctctctcgttaaattacagaggcaggagattaaaaatacacttaaataaattgatacatatttaacttaaggggttggccaaaaatattaggcaa

SEQ ID NO: 32954 - DNA, 660 bp, Homo sapiens
aagccacatccaagcttaggaggaaagagtgtcatttattagtgatgtctgtcatggtcatcaggaatgaatctataagtgccaggcatttaccacttctgcactagagatgcagagatgtggaggaactcctgtagccctcactgcctccagctaattttagctgactgctaattaacaagctctgtgtactaagccattgctatatatccgggaggacgttgtcagtgttgccacagatatgaggccaacctggatcacactggctatgcgtctcttcagtcaaatcctaagctaagcaatgatttctatcaccataagtcctcagagtgttcgtgaagtgcacacatgactgtggggcaacctgatggaatgccttctgggctcaaaataatatactctaccttctctttgcccaaatgcatattttatattgctacatgcaagcacaacctcttaatggggaaaaaaattctaaatcacttttctctctcagtttacgctgaaatccagtagaaatgcgttaggatataaggtaccatccatatactctcctttatggagttgataagaaattgctataaaccagagcagtgagagctggcttatataatgctatcccctgtctcacttgaaaacagggtgaaacacagaaacaaa

SEQ ID NO: 32955 - DNA, 528 bp, Homo sapiens
tggtcagctgttggggggagaaaatccacacatctggtgtcagaagtgtcgtgagtgaaaacagaccatcactccaccaagtggccagcatttaaattcatgccacacagagggaaccatgacagtctggtactgatgaccatgcagggttagccagggcagcagcaagcgcatcgaaaggacaatcccatagtcaagtaaggagaagtttgtatcatatgtgagaatgaagcttaaatggactgaacaaaatcttaaacattggcatgacagaattctcataactaagaggggatgaaaagttatgagatctaaattagaagttatgaagacatctgtcacccagtaagggtgggagggacaacgtatcagttgggggcaggtcctggaataaactaagccagctcttttttattttttgagatggagcctgggtgatagcaagactctgcctcaaacaaacaaagataactaacccattttgattccttaattagttaaataaaatgaattaattacccaaaccta

SEQ ID NO: 32956 - DNA, 340 bp, Homo sapiens
gagtcatccaacgcacagtcatcctcaacacctccctctcacccccacgtggaattggtcatcaactcctgtggatttcatcttcagaaaggctcctcctgtcttcccccactggcagcatcatagggcaggacctggcacttctctgattcccacagatgctccccaggaggcctccccaccccctccttacccctccagtccatcctccacacccaccatcccaagagagacctttctaagacagtctaaggccaggcacggtggctcatgcctgtaatcccaacactttggaaggtggaggatcacttgaggccaagaattcaagatcagcctggac

SEQ ID NO: 32957 - DNA, 468 bp, Homo sapiens
cttcttttctggtgctttacttgttgctcatttctctgacccttcattcctgttacctcagcctggatgattttacccagatccaaccatctatatctgacagctcccaaatttctctctctgtaacgatgacttcctccaactccaaactactaaactgcccaactgatacttctatgtggataggcaacagaattcttagtattctcccttaaactctgccctactcaagtgttgcccatcacagaaaatgtcatttccatgaacctggttttagaagagaattttttttttaaagtaagtccctagtattcatatttgactcctcccactctcactccatatctaatccatccacatattacttctgtctttaaaatatatctcaaacccacacacttctctccaactccaaactccaaccccagtctaagctcccaccacggctgccatggaacacggccagcc

SEQ ID NO: 32958 - DNA, 1523 bp, Homo sapiens
gtcccacctgtatcccaggaaggaatttctccagccttgaatttttcattctgaatttcgctctcactgttctttggcctttgtgggcattttcagttaaactggcttattcttactctttctcagaaaagttgattctaaacagctattcctgcacctggggtacagggtacaaaaatggcaggtggaatgggcaggtttgagccttcactagaaaattgactttagatctgtcccttaacctctctgagcctcagtttcctcaccaataaagtgggactcagaatacctacctcacgagatagctgtaaaaggaaataagcaagctgtgagccgtatgcagattataaagcacaaatgagtgtagagtatttatctgagctccatgtagcatggtgttcattttgtgggctaattccaggtgacaactttaccggcagcgtcactacctgtggatttcagaggagcctgaagatatggatgttacatccgctgcccttggctagacattagacagctgagatgttagttcattggtggctaactcattttcagcattgctatctgctttttatgatattaatggctccactctcctcccagttgcccaagcaggaaactgtaagggtgattttgtctccttttcctctcatcccagctccagtaggtaccaggaccttcaaggtgaggtctgaaattcaaacctggagtgcatctctcccctcctctgcttccactgctggaccctggttccagtcctcatctaaactttggcacagacattctgattaatctcttgatcacctggctttctcatttcccctataccagtctgttttatatcctcaagccaaggtaaacttcctacgccacaactctgcgtctgtttatcttttattattattactattatatattattattattattattattattttgagacagggtctttctctgccactgaggctagcatgcagtggcatgatctcaattcactgcaacctccacctcccagactccatccttcctcctgcttcaggtttgtgattagctgggactataggcacataccatcacgcccagctaatttttgtaattttagtaaagacagggttttgccatgttttccagccagacctccacctccagaaatcaagtgattcaccacctcagagtcccaaagagctggaattacaggaatgagccactgcacccggcctgtttctctacttattccaacataaataagggtttttctttgacatggtgctggagacccaaaatcataattctatacatgattcctcatcgcctacagaattaaattcaaactttccctcttatacccaactctccacaatcactctattctccataaaaaatttggtgagtctcccatgactctagcaatgcttatatttcacggatgtgtgacaattcactgctcacattacttttctggaataagatggggtagaaacagatgtttgctctttcccaataaactgctacacatgctg

SEQ ID NO: 32959 - DNA, 1468 bp, Homo sapiens
gtcccacctgtatcccaggaaggaatttctccagccttgaatttttcattctgaatttcgctctcactgttctttggcctttgtgggcattttcagttaaactggcttattcttactctttctcagaaaagttgattctaaacagctattcctgcacctggggtacagggtacaaaaatggcaggtggaatgggcaggtttgagccttcactagaaaattgactttagatctgtcccttaacctctctgagcctcagtttcctcaccaataaagtgggactcagaatacctacctcacgagatagcttgtagagtatttatctgagctccatgtagcatggtgttcattttgtgggctaattccaggtgacaactttaccggcagcgtcactacctgtggatttcagaggagcctgaagatatggatgttacatccgctgcccttggctagacattagacagctgagatgttagttcattggtggctaactcattttcagcattgctatctgctttttatgatattaatggctccactctcctcccagttgcccaagcaggaaactgtaagggtgattttgtctccttttcctctcatcccagctccagtaggtaccaggaccttcaaggtgaggtctgaaattcaaacctggagtgcatctctcccctcctctgcttccactgctggaccctggttccagtcctcatctaaactttggcacagacattctgattaatctcttgatcacctggctttctcatttcccctataccagtctgttttatatcctcaagccaaggtaaacttcctacgccacaactctgcgtctgtttatcttttattattattactattatatattattattattattattattattttgagacagggtctttctctgccactgaggctagcatgcagtggcatgatctcaattcactgcaacctccacctcccagactccatccttcctcctgcttcaggtttgtgattagctgggactataggcacataccatcacgcccagctaatttttgtaattttagtaaagacagggttttgccatgttttccagccagacctccacctccagaaatcaagtgattcaccacctcagagtcccaaagagctggaattacaggaatgagccactgcacccggcctgtttctctacttattccaacataaataagggtttttctttgacatggtgctggagacccaaaatcataattctatacatgattcctcatcgcctacagaattaaattcaaactttccctcttatacccaactctccacaatcactctattctccataaaaaatttggtgagtctcccatgactctagcaatgcttatatttcacggatgtgtgacaattcactgctcacattacttttctggaataagatggggtagaaacagatgtttgctctttcccaataaactgctacacatgctg

SEQ ID NO: 32960 - DNA, 352 bp, Homo sapiens
gttagctgaacacattttcacagctcacaccacacatctgggtctccacaccttccaccctgggcatctggattagcatccagcctcggcccctccgcccctccactccaagccatcacctggatttccccatgcctggctgacagtcctgagtcctggtccaacatgcttccagcaaaacactgctgaaaaggaaatgatggtcttctgaatagagaaagtaaaccattacagattttgataaaagtaaaattctctcagagacgcaggacaagttccttacgttttctagctttcttgaataaatacggtggtcagggccgtatatagatgggtaatagcagatctcatc

SEQ ID NO: 32961 - DNA, 449 bp, Homo sapiens
tcaatactttttaaatcttttcgcctggttacttatttagcatttgccttctgagtatattgtatcatatgtgtcttgtggtctctggacaggattaattttccaagtgtctgaccacaattgtacactcttttctgctataaatttgttttctcttttctctcctcccctcctctcttcttttcttttctttttgatggagtcttgctctgtcgcccaggctggagtgcagtggcgggatctcagttcactgcaacctctgcctcctgggttcaagcaattgtcctgcctcagcctcccaagtagctggcacatggtggcacctgtagtcttagatactcagtgggctaaggcaggaggtttgcctgagcccacgagtttgaggctgcagtaagctgtgttcacatgactgcactccagcctaggtgacagagtctcagaaaaaaaaa

SEQ ID NO: 32962 - DNA, 442 bp, Homo sapiens
atgattatagattataataaaagattagtgtactgctgtgaacatctgtgtcattttcagagctaccaccgtggattcctgagcaacttaatgcatgctgtaaataaagaggctgacccacatcttgtggctaaagaacaaatcaaacatcctttgtgacatttgtctgaaaagagggtaccatgtgattttcattttgtcaacttcactcccaaagggtatttaagagaaaatgcacgtttagcattttctgaacattatattagtggagggactcacataacattttgtaagtagaccattctaagtaacatctttttaattcagttttttggtatcttgtttttaaatagcagagtataccattaaagttaaatctgatgaacaccaccaacacattttagagctaataaaggcatatcacactttatatgtctttggt

SEQ ID NO: 32963 - DNA, 493 bp, Homo sapiens
taaaactgctacttctggaatatttcttaaacttgcttgatttgtgtaaggtctggctgctgggctccctgaaaccttgcacatatcttactgtatgactgtatttcgttttgagtctctggattctggggtttggacagatgaccatagtgaggcctgcagaaatatgcatgtcctcagtgtttggactgccagctgcaaggcagagccaaacccaatatggccccatcatccctggctcagctgtgctacctggccatgctggaaggggtttgatcttccaggaatttgcttcacagctctttcctgtcccaagatctatgcctgatgtgtaaattcaggacccaaaagggcacaaaaaagcaataactactaaatataaggaaaacaactctgtatacagcatgtataaagaaaagcaagatatatttggggagataaaagttgtaaaggcattaagatgtgtgtttgttgagaaaaaataaatttgtgc

SEQ ID NO: 32964 - DNA, 399 bp, Homo sapiens
tcatagactgtagcaaggagactggactttctcctgaaggcactgaggcacatggcagggctctgggtactgcagagatagggtcacatttgtgttttgaaaagatcctcgggcggagcacggtggctcacgcctgtaatcacagcactttgggaggctaaggtgggcagatcacctgaggtggggagttccagaccacactgaccaacatggagaaaccccatctctactaaaaatacaaaattagccgggcatggtggcacatgcctgtaatcccagctactcaggaggctgaggcaagagaataatcacttgaacccgggaggcggaggttgcagtgaaccgagatcacgccattgcattccagcctggacaacaagtacaaaattctgtctcaaa

SEQ ID NO: 32965 - DNA, 351 bp, Homo sapiens
ctctaatgtttgcagcctgctgagcctaacaaggcagtggtctcaagaacattctttgtgcctttttaaagtactccattttatttttatgatagttatgtatttatttcacagatatatttaagtacccactttgtgtcaggtacagtacaagcaatgaagataaaacagaaaccaaaacacactcccttacagggaaaactgacaccacgttgccacaaaatgttgagtatagtcaactctgctgtgtggatcggagggcctgcatttatcctacaaataattgaatgtaatcctacattcatgtattcattggcagtacggagtaataaatgcagcaatgtcataaag

SEQ ID NO: 32966 - DNA, 521 bp, Homo sapiens
gaacctcctggggtctgtcagagcttgggatcctaatcctacacactctgctttatggagtaggtcctgatagatagacagcatagcctgtgttttcctgcccacctctgatgctaaatgcaccctgaggcctgagaaccaggtgccaattaaagctcattaggataccattgtctcaggcagaaatcggtacttctgattcagtccccatttcactgggctcctgtcccacagaatgatgggagcagtgggctctttggggcgtttccttaacctgcccagagctccttcctcatatatgtccttctagatcaccataaaagtcaacatttacattgaagctggtattaatgccaaagcacggggagttttctctaaaacagaaaatgtccaatttctaaagatcaggttccagcacagataagtgttgacttcagcccttctgggagctgctgccatgcataccaacagggtcccggcgctgtgctgagacaacccacgcttctaacagggtgtttgtc

SEQ ID NO: 32967 - DNA, 355 bp, Homo sapiens
tttttttttttgtagagatagggtctctttatgttgcccatgctggtcttgaactcctgggctcaagcagtcagcccaccttggcctcccaaaatgctgagactacaggcatgtgccaccatgcccggcagcctcctaagtcttaatagcttgtactaatatttctcttaaccaagatctttcagcctggaagtgatgaggttgcacatgtgccttcgagggattcctctgagaactgcatggaaactcagttgtagtggggaggcaggccagaggcagagagatgaggagggctcagttggcagaaagagtgtgaaggtggaattgacaggtagctgtgtggagatgagggcga

SEQ ID NO: 32968 - DNA, 506 bp, Homo sapiens
aaaacaatcatctccatcattttccattttacaaaaattaatgctactttttatacaaaaataaatacttaaaaaattagatatcactggattcatcactaaaatctggaaatgccttctcctctgtatatagcaggtgataagaaattcttgttactttctgtgttttacattctctattcttaccaggtgtgggaatttagttacctgacctggaagatgatctctaaatttgcatattccaaagccttatctattcaagacaaattacttgactcactgtgttatttggttcaaagtattgctgtcactatgattgcttatggccatgtccagaaggcaaaggaaaatggagcagcatcctgcagatgactgaggccaacctaatgccctatgctccccaaaagacaggacagagaaagattatttggaggcagtgaataaattgcctcagttctctgctttattttataagggcaaaagtggcctttctggacatgacagct

SEQ ID NO: 32969 - DNA, 330 bp, Homo sapiens
agccggagggagggtctggctggcggcagcgcgcaaggccgcaccgggtcacgcttgattcccgcggaatggggcgcaggttgccagaccgggtccccagtgctagggctcaaggaagaatttgttcatgcagaagatttagaaaaatactatgtaaaagagtttggagtaagcctcccttaatataaatgagatttattatctgccggaaaaagcagattatgtttcttattactgaacgcctgaagtaccaacgactcaaccagagcccacagaattcaatatcctgggtggtaaaaggaacaaataaagcaacacggaaaattaaaa

SEQ ID NO: 32970 - DNA, 1434 bp, Homo sapiens
gtctcattactgatgtgatgtcactttcaagattaggttataaatagactatggcttcaatcagagggttttctctctgtctagctctcttttgggtagttcattctgaggaaagccagctgccacgttatgatgtaggcctgtgaggtccacgtagcaaagaacatatggaagatttctaccaccccctaactaagcctttagatcagaccgcaaccccagccaacaaggtagctacaaactcttgagaagccttgagacagaggtactcaatagagccattcctatgagaaacgtaagtatctgctgttttacaccgctaaggttttagctaatgtattatgccataatagataagttatatacaacctttatcaaataataaaagtaaccatcatcagtaatgagacaaatcaaaaaccatggcccacccaatagaacataatgaggagagtacagaattgcttctgggatatttctgacaaagatgtatatgcttcattcatacatgaggaaacatcacacatactcaagatgggagagccattctaaaaaataactaggcagaaatcttcaaaaatattaaagtcacggaaaccaagaaaaaatatgaacctgtttcagattaaaggaaactaaacagacctaacattttaatacaatgtttgattttgaacttgaactttttgttatataagacactattgagacaagtgctaatgcttgaatagggctgaaggattagattataataatacattaatgcaaatttcctgattttaaacattgtagtttgattgcacaaggagaatgtctttatgtgtggaaaataaatagtcaacattctgtcttcaagcttctgagaaaactctgcttttagggcatagatagaagtggatgataattcacctgttcctctgctactaattgagctgctctctgtttccatggctggctcatgggatgagagaatatatctagttttttatgtttcaatttgtctctctatggcatttttgtgaaaataaggaagtgtggagacttatatatgtttctaaattgtaatagttcattaatgtaaagtacagacacagtcttcacttttccttcttagaccgtttaaatatggccacgaaacaagtagtctctggttggctggacactgtggctcatgtccttaacaccaacactttgggaggccgaggcaggcaaatcacttgaggtcaggagttcgagaccagcctggccaatgtggcaaaaccccatctcttctaaaaatacaaaaattagctgagtgcggtggtgcacaccggtaatcccagttactcgagaagctgaggcaggagaatcacttgaacctggaaggcagaggttgcagtgagccaagaccgcaccactacactccagcctgggcaatagagcaagactccatct

SEQ ID NO: 32971 - DNA, 425 bp, Homo sapiens
gaggatggtggggggcactcttctctttacctctttctttttgtctttttcccatgtgggctaagaaggatcctgctaattcctggggggcctgggaacttgattaagggaggggcaaggcaggtggggtgattaatggttgctggacagctgtggtttatttttatttttttattttttagagaccaggtctcactctgttgcccaggctggagaacactggcacgatcatagctcacttgcagcctcgaactcctggactcaggagatcctcccacctcagcctcctgagtagctgggattataggtgcatgccaccatgcccagctaatttttatttatttattttttatcttatgtatttatttttatttgagatggagtttcgcactgtcatggggctggagtgcagtggcacaatctcg

SEQ ID NO: 32972 - DNA, 467 bp, Homo sapiens
cttaacatacacagaatatgtattttgcatcataaacctatttaaaaaacaggttttcaatgtttatgtacttatgtgctgcatatctgttactttgtagaaaccagaagagcattcttatcaaggtacattatttttcagctacagtactgagttttttctgcctatgggatagtaaccacagtcttaaatcactaaagagactgtatttttgtataatgtccattgaatatgaagaaagcaacagtccttataattagaaatttcatgaaagcaaaagttttgcatacccaaatgaaggtactgtggaccccatgtcaaactgttaaatatattgtgtacgatctgtatatatactatatataaggcatataccgtgtggaaggcacagtcaaataatagttctgtgtactgttcttgtaacattagatctttttaataaataattctctttttattgactttta

SEQ ID NO: 32973 - DNA, 347 bp, Homo sapiens
  misc_feature (320)..(320): n is a, c, g, or t
atcagtagttgccaagaggtagaggtgggagaggagttggttgtagtgtggcaatggggaattttttgagtgttggaactcttctatattttggttgtggtagtggttacacaactgtgtcaaaacttacccagctgaacatgaaaaagatgaatattactgtatataaaaattacaggccaggcgtggtctataactcctgacctcagatggtctgcctgccatagcctcccaaggtgctgggattacaggtgtgagccacggcaccaggccttcatcccattacattctaaagattgtgtccaaaatggagttattgnttctttgtggaggtgatggggaccctt

SEQ ID NO: 32974 - DNA, 465 bp, Homo sapiens
ctgctgagagttggtaaagaggatggtcgagtgagatggtgttgacctccctggatcttatgtcactacatcctggacctcaagagggtcatccaagctttttgaaagctgaactccttgactggagaaacctagacaagaggcggggccaggtgcttgatatctaggaggcattcttcctcttcccttgccaccatggagctgggcacagtaagccatattgtttcctgaagcaggagtcccaggccttggctagagagggaacagatgtctaacaaaaagagaagcaattcgaggaattgatgaagcacaattcaaaatcctctctggctagtagctctctggcttctgttcatttgaagaataaatcttggctgacagtgggaagcaccaggtttgaaatcagatggctttatttttctttttttggcatttaaatcagtgaaataaaattattactggaga

SEQ ID NO: 32975 - DNA, 352 bp, Homo sapiens
ttttactattattttaataggttagagattaaaatgtcatccatctttgatttatctaggcctatatgtatatacacccctaccctgaccaacagacaattgtataattctctctatactttaagtgccacaagagttatttaatgtgtcacttagattaatccacatatttaccctttttgttgtttcttcattccctgaatcttcatgtttcttttacaaacttcaagttttttcttctgcttaaacaaaaactttagtatttcctttaatgtagggtattctgggtaaggaaagtcccataaatttgtctacaactgtccttgtaactttatccttgaaggcattttca

SEQ ID NO: 32976 - DNA, 492 bp, Homo sapiens
tgaaatttgggtggggacatggccaaaccatatcaccatgtgaagatgaaagcagaggtcagggtgatgcatccatgagccaaggaaccccaagcattgccagcaaccaccagaagctgggtgagaggcacagacaggttctgtctcacagcctcagaaggaaccaacactgacatcaccttgatcttggacttctagcctccagaagaaggctacatttctgtgacaatatatttctgctgtctaagccatccagtctgtggtactttgttatgacagccctaacaaactaatacagaggaggtgcagttattagtaatgacaaggagcagggtgtggccatgagaggtctttggaggagaggagatcgtggaagtgagaggccagggtatggggaggatgtatctacgtgaatattgaaatctcttaggacctggtgcagtggctcacgcccggaatcccagcactttcggaggctgggaggaggattac

SEQ ID NO: 32977 - DNA, 995 bp, Homo sapiens
ataactacttttttgtactataatccagaaatcaaaagacctaaaagttaatatccatactcacatttaattagatactagcttttatggcagcatgtttcataggaagggctgtcataggttggtgctttgtagctcactgaagtgtcctacacagtatttgatgacaaggaggaagctatatcaatttctagtacacccaaacccaatcaggtagttcagggtcaaatgtaattatggaatcatttaaattctaaatgtaaataaatacaggactacttcagacaaaatgttgttttaaagtagatgttttataaaattggtattcttgtttggaagaacacagctcaactgttccttactccccttctgcatgttcaaaagaatgtgtagacttaggaacaagagacagcaaagtttctcggtcttgttgcctgttggcaacccttaagggttggggttggggcaggggtggagatgttgataaaaataaagagttgggattttaattatccataattctgctatcccctatgactgcaggtaattgatagttggctatatctgaaaggtatgaaaactatgtgacagtttagatgacagatgagatcaattatttgactcaactcacccagttgtactgattcacaaggtgccaccaatatgctttcatttttttggaagtggtttcaacatgtagttgtttcttgggactttggctgctcaggtcttagtggtgtatcagggagactgcagttctgggcagcttcacttaattggcctcagattcgttgattgtcctgtctcctctgcaatggaaatgcatgagtgatcctgtaatggatatagctgagatttggagtgaacatgggatttggagacccaatacctgggtttagaaagtctccttactaactgtgtgaccttgggcaagtcacctaactttaaagcctgttacattatctgtgtaatgggattaacaatactttcacatg

SEQ ID NO: 32978 - DNA, 705 bp, Homo sapiens
cagctccagaagaatgagcctgcacagcttggactgtcacctctggcaggttcctgctctttgatgaagcctcgtcataattacaggtgtttgaaagttcctccattgatcttctctctcctgctgccttgtcaagaaggtgcctgcttcccctttgccttgcaccatgattctaagtttcctgaggcctccccagccatgtaaaactagccttatcttcaacagctgccaaaattgaagaacaaaaagaatctttgaaacttcccttcaactggtcatcctcttccctttttctctcctttaaacactgttccaattcattatgatggccccaaagcaaagacagacatggaagtgaacattggagtggaaggaatgacggggagcaaatgtctgctttctttctatcattcttgtatcaactctaaattgaaacccaaatcactgaaatctaaaaaatcacatgaaagcaagtcaatgactaaaagaaaatgaaatgagagaccctatcagagaaatatgaaagggaaaataccactgattaaataagttatgggaaaaataaatcattacaccattaaatgtatacgtcgacatactgtatgttgttatgtgcttattgtctttcaccagtagaatgtaagtcccataagggtaaggactttatatattcttttcacagcagtgtctctagtgcatggaaca

SEQ ID NO: 32979 - DNA, 2533 bp, Homo sapiens
aagggtagttctcattaggatgtataagtagtggcttgaggcaccttcttatcattttttgcatgttattctgattattaaacttcccccaatgtcatattccatgatgagggatttctgaactccatagtccagcgttgttgcttttctctcttctttgctactgaaaattgccagcagtaccgccatcagcacaccaaatctacccccacttatgtttgttctgccccatttcccaggagcagcttctagcacatatgtagagtatctggcaccaccttagcccagggctgcgtgcctgatcagtggggattctgttcccccaccccccagactgcaagagcttcttaagaaggagcccatattcccatttgtagctggaaagcgggtgaatgacatgacatggggcacctaggaaagatgattattagaggagtgcagcggaaaaaaatttgcactcttctccttttggttattactttccaaatatattaacaaaaagttgatgcttttaactttatattttcagaaaagtgtttttaattaaaaatatgtgatagggaccaaataagtaaagtacatttttctccactaaatttgaagtgagggaaagaggagccaaagtaagagatttttttttaaggaaacttaatctgattgtgaaaatcatacatatggagaaacatcagatcaggcaatagagtcagagggtcatgagcaatagacgatgatgcgaggcatttggggagcttcctggaggaaaattaagtttttttcctagcaaactaccatgtcctacaagaacttggttatataatggtgcgtctctgaatcactgattaaaaccagttgcttctgattttagtcacaggttttacaagtattcagctctccctcatgtttcatttctttttttaagataatctatcaaccttttttaaattttaaaatttttagatgtagagtttataagtaaaatatatttttagccattgttctgttagctgagctgatgtgtttggtcttagagggcctgacttcagatactctttgtgatcttgtaagggctctacacaaacttcattatgtatggtaaatttgtattcttatggattgtatatagaatgctttcgttagaagtacattctacttctgtatgtccctttgtaatccgcagttgcttactcaggggtttcatagtcatttcataaaaaataattcactagctgtctaatggtattttaagactgtttatctgtatcacaacgtcattaggagttctttcaacaattccataaatatactgtttactagaccttccctgtaaatgttcccaattcccatcctgtctcagacagtcaatagtcctgtgtacagtgactatttgcatgatttctcattgcactgctgcattcaggcactccagggcatgattaaacagtcattaacagtgcctctctggtacagttgatgcatgcattgatctttcttctctgctgtttttatatagcctttaattaaaaggaaaaaaataccactactctgcaatgcaaaagtcttcaaaattctttgtttcctgtattaatcacttctgttccagagtgaacaaatgttttcagctaagctatgtgagaatgtaagaataatatcctgcttgttctaaatagttcatatatttaaagtgtggtcagtatttcctccctgtaccttacaaacagaaaccaccctgggatggttgataccccttacaaagtcgatcttacccacacagactcctgtgtatgcgtgtctgtttataggtgtatatggagtcagtgttgataggaaggatgctctagaagtacttctgttgtttcctagaaggctatgagccagttccatggcatgtttaatgtataattcccatgtatcatgagaatttcactagaatgtcattaaacagcccaactacctcatgtgaaattggctgtggacaatctgtgtcagatgagaaatgtgttcagataaatttaatctggttaatagacttaacaaattaatgtctacataaagaagaaacatgatagaccagatgccaaaggctaaaatgtacatagatttccttggattaatttttaagtcactgtttaattccatgcctagtattcttatgaatgtttgtggtttcatagatttatgcactttgaatatctgtcacgtgcagtgttaatgttacctgttcttgtctctcagcattttgaatgagcatcataatcagagtagaaggcaagttaaactataaaagtgtcaagtggcttgttaacttcttaatttaatggacctttacttagaatataatatgttggagcctcttgggaccaaccgatgagcgacagtttcatgtttagatttgtattgtttctctgtccaagtccttattctctatcttgtggggaggggtgacaggggagggttttactttttttgcaaaaatgtttgaaaatatctgtcagattttatattcgttagttataataaacttatttttaaagta

SEQ ID NO: 32980 - DNA, 2612 bp, Homo sapiens
aagggtagttctcattaggatgtataagtagtggcttgaggcaccttcttatcattttttgcatgttattctgattattaaacttcccccaatgtcatattccatgatgagggatttctgaactccatagtccagcgttgttgcttttctctcttctttgctactgaaaattgccagcagtaccgccatcagcacaccaaatctacccccacttatgtttgttctgccccatttcccaggagcagcttctagcacatatgtagagtatctggcaccaccttagcccagggctgcgtgcctgatcagtggggattctgttcccccaccccccagactgcaagagcttcttaagaaggagcccatattcccatttgtagctggaaagcgggtgaatgacatgacatggggcacctaggaaagatgattattagaggagtgcagcggaaaaaaatttgcactcttctccttttggttattactttccaaatatattaacaaaaagttgatgcttttaactttatattttcagaaaagtgtttttaattaaaaatatgtgatagggaccaaataagtaaagtacatttttctccactaaatttgaagtgagggaaagaggagccaaagtaagagatttttttttaaggaaacttaatctgattgtgaaaatcatacatatggagaaacatcagatcaggcaatagagtcagagggtcatgagcaatagacgatgatgcgaggcatttggggagcttcctggaggaaaattaagtttttttcctagcaaactaccatgtcctacaagaacttggttatataatggtgcgtctctgaatcactgattaaaaccagttgcttctgattttagtcacaggttttacaagtattcagctctccctcatgtttcatttctttttttaagataatctatcaaccttttttaaattttaaaatttttagatgtagagtttataagtaaaatatatttttagccattgttctgttagctgagctgatgtgtttggtcttagagggcctgacttcagatactctttgtgatcttgtaagggctctacacaaacttcattatgtatggtaaatttgtattcttatggattgtatatagaatgctttcgttagaagtacattctacttctgtatgtccctttgtaatccgcagttgcttactcaggggtttcatagtcatttcataaaaaataattcactagctgtctaatggtattttaagactgtttatctgtatcacaacgtcattaggagttctttcaacaattccataaatatactgtttactagaccttccctgtaaatgttcccaattcccatcctgtctcagacagtcaatagtcctgtgtacagtgactatttgcatgatttctcattgcactgctgcattcaggcactccagggcatgattaaacagtcattaacagtgcctctctggtacagttgatgcatgcattgatctttcttctctgctgtttttatatagcctttaattaaaaggaaaaaaataccactactctgcaatgcaaaagtcttcaaaattctttgtttcctgtattaatcacttctgttccagagtgaacaaatgttttcagctaagctatgtgagaatgtaagaataatatcctgcttgttctaaatagttcatatatttaaagtgtggtcagtatttcctccctgtaccttacaaacagaaaccaccctgggatggttgataccccttacaaagtcgatcttacccacacagactcctgtgtatgcgtgtctgtttataggtgtatatggagtcagtgttgataggaaggatgctctagaagtacttctgttgtttcctagaaggctatgagccagttccatggcatgtttaatgtataattcccatgtatcatgagaatttcactagaatgtcattaaacagcccaactacctcatgtgaaattggctgtggacaatctgtgtcagatgagaaatgtgttcagataaatttaatctggttaatagacttaacaaattaatgtctacataaagaagaaacatgatagaccagatgccaaaggctaaaatgtacatagatttccttggattaatttttaagtcactgtttaattccatgcctagtattcttatgaatgtttgtggtttcatagatttatgcactttgaatatctgtcacgtgcagtgttaatgttacctgttcttgtctctcagcattttgaatgagcatcataatcagagtagaaggcaagttaaactataaaagtgtcaagtggcttgttaacttcttaatttaatggacctttacttagaatataatatgttggagcctcttgggaccaaccgatgagcgacagtttcatgtttagatttgtattgtttctctgtccaagtccttattctctatcttgtggggaggggtgacaggggagggttttactttttttgcaaaaatgtttgaaaatatctgtcagattttatattcgttagttataataaacttatttttaaagtattaagttcttaaaggtttttgtgtggttttctgcctaattgaatatgtcaataaaaagtctcgtttatggaacacacat

SEQ ID NO: 32981 - DNA, 315 bp, Homo sapiens
taccctcactaaggaacaaactggacccaaccgggtgcgccctctagaactagtgaccccgggctgcagaattcgcacgagttacttcttaatttaatggacctttacttagaatataatatgttggagcctcttgggaccaaccgatgagcgacagtttcatgtttagatttgtattgtttctctgtccaagtccttattctctatcttgtggggaggggtgacaggggagggttttactttttttgcaaaaatgtttgaaaatatctgtcagattttatattcgttagttataataaacttatttttaaagta

SEQ ID NO: 32982 - DNA, 1981 bp, Homo sapiens
ggcacgaggcgagggttgcttgggcagcgactgtcatggcggcggccgcccccaatgccggaggctcggcccctgagacagcgggttccgccgaagctccgctgcagtacagcctgctcctgcagtacctggtgggtgacaagcgtcagccccggctcctggagcctgggagcctgggcgggatcccaagtccagccaagagtgaggagcagaagatgatcgagaaggcgatggaaagctgcgctttcaaggctgcgctggcctgcgtgggaggatttgtcttaggaggtgcatttggggtgtttaccgctggcatcgataccaacgtgggctttgaccctaaggatccttaccgtacaccgactgcaaaagaagtgctgaaagacatggggcagagaggaatgtcctatgccaaaaatttcgccattgtgggagccatgttttcttgtactgagtgtttgatagaatcttaccggggaacatcagactggaagaacagtgtcatcagtggctgcatcacgggaggagctattggtttcagagctggcttaaaggctggggccattggttgtggaggttttgctgctttctctgctgcgattgattattacctccggtgagagtaattgcctgcagggaaggatgatgccagccccggatccgggctgctctctggaggacagtttctgtaccacaccagggccttgcttcagggcctgaagacattcattttccctcatgtcgttggtattctgagggagctgcctggcttctctgcctccagcctttggggtagccacactttgctgctcctggactccagccagccttcacagaggacgtcccgtgccagattctctcacagcagatcgggagacaggatgttgacatataggaattcagctccacaaagcttcaggcctgaccacagctggccctctaggttgtttggtgttgtgggcacagaggtgacagtgtctctgcaggcactcaggaagctgttctaccttggaactccatgcaactatccgtctcgaataccagggcagggcaaggcggactgatgccgtccaaccaattatctcacttgttttgtgttctgtcatccttgttttttttttaaaaatacactcccctcccccaccgccacacaccttacagttcaaaaggttggtttatttgtattttattttcaaattccctattccaaaaatagtgccgggtggcccaaagataacatctgaagggaaagaatgagaaagctcccagggaagcgggggatggggcgctgaggcagggttgttagaggactgtgtcatcctcaccaagctcattacatctgccagggcctgcctcaagaagcccagcccagccttttcctgggatgcagtgaaatcccatccatgaactcgatgggcccctcctgtgccggccgagaggcacacactgccttcacgacgtgactgctggacctggccgagcttgaggccacatgtgaagggtcctgctgtggtcatcttggtgactcggtcacagcagctactggccaagatcagacgtcgctgaggggctgttcaccaccatcctcgttctccagggtcaaggaagtgttttaacatgtcgtgttttcgacttgaccttgtggtatttttcttggcctagttgtgtgccatggatattaaaaaaaaaaaaaaaaatccgtctacagttgggcttcagcactggtgctgctttaccctggtgctctgtggggggatgacactgctggagtcaggcctttgctcttgggtggggcacaggcaggtcgcttggtgggggccacacagtgctgggcaccttcagccagtggtgatgagtctcctttttcctataatacggtaattcctctatcctttccttttttgccttcttcctcatctgccctgtcttctggcccacacactcttaaccagcgttcacactcagtgtacatggcctggag

SEQ ID NO: 32983 - DNA, 1980 bp, Homo sapiens
tttaaggctaggtacgaggcctggtgttgctgtcatggcggcggccgcccccaatgccggaggctcggcccctgagacagcgggttccgccgaagctccgctgcagtacagcctgctcctgcagtacctggtgggtgacaagcgtcagccccggctcctggagcctgggagcctgggcgggatcccaagtccagccaagagtgaggagcagaagatgatcgagaaggcgatggaaagctgcgctttcaaggctgcgctggcctgcgtgggaggatttgtcttaggaggtgcatttggggtgtttaccgctggcatcgataccaacgtgggctttgaccctaaggatccttaccgtacaccgactgcaaaagaagtgctgaaagacatggggcagagaggaatgtcctatgccaaaaatttcgccattgtgggagccatgttttcttgtactgagtgtttgatagaatcttaccggggaacatcagactggaagaacagtgtcatcagtggctgcatcacgggaggagctattggtttcagagctggcttaaaggctggggccattggttgtggaggttttgctgctttctctgctgcgattgattattacctccggtgagagtaattgcctgcagggaaggatgatgccagccccggatccgggctgctctctggaggacagtttctgtaccacaccagggccttgcttcagggcctgaagacattcattttccctcatgtcgttggtattctgagggagctgcctggcttctctgcctccagcctttggggtagccacactttgctgctcctggactccagccagccttcacagaggacgtcccgtgccagattctctcacagcagatcgggagacaggatgttgacatataggaattcagctccacaaagcttcaggcctgaccacagctggccctctaggttgtttggtgttgtgggcacagaggtgacagtgtctctgcaggcactcaggaagctgttctaccttggaactccatgcaactatccgtctcgaataccagggcagggcaaggcggactgatgccgtccaaccaattatctcacttgttttgtgttctgtcatccttgttttttttttaaaaatacactcccctcccccaccgccacacaccttacagttcaaaaggttggtttatttgtattttattttcaaattccctattccaaaaatagtgccgggtggcccaaagataacatctgaagggaaagaatgagaaagctcccagggaagcgggggatggggcgctgaggcagggttgttagaggactgtgtcatcctcaccaagctcattacatctgccagggcctgcctcaagaagcccagcccagccttttcctgggatgcagtgaaatcccatccatgaactcgatgggcccctcctgtgccggccgagaggcacacactgccttcacgacgtgactgctggacctggccgagcttgaggccacatgtgaagggtcctgctgtggtcatcttggtgactcggtcacagcagctactggccaagatcagacgtcgctgaggggctgttcaccaccatcctcgttctccagggtcaaggaagtgttttaacatgtcgtgttttcgacttgaccttgtggtatttttcttggcctagttgtgtgccatggatattaaaaaaaaaaaaaaaaatccgtctacagttgggcttcagcactggtgctgctttaccctggtgctctgtggggggatgacactgctggagtcaggcctttgctcttgggtggggcacaggcaggtcgcttggtgggggccacacagtgctgggcaccttcagccagtggtgatgagtctcctttttcctataatacggtaattcctctatcctttccttttttgccttcttcctcatctgccctgtcttctggcccacacactcttaaccagcgttcacactcagtgtacatggcctggag

SEQ ID NO: 32984 - DNA, 1957 bp, Homo sapiens
aggtgtacgctcggatgttacgggaccccaatgccggaggctcggcccctgagacagcgggttccgccgaagctccgctgcagtacagcctgctcctgcagtacctggtgggtgacaagcgtcagccccggctcctggagcctgggagcctgggcgggatcccaagtccagccaagagtgaggagcagaagatgatcgagaaggcgatggaaagctgcgctttcaaggctgcgctggcctgcgtgggaggatttgtcttaggaggtgcatttggggtgtttaccgctggcatcgataccaacgtgggctttgaccctaaggatccttaccgtacaccgactgcaaaagaagtgctgaaagacatggggcagagaggaatgtcctatgccaaaaatttcgccattgtgggagccatgttttcttgtactgagtgtttgatagaatcttaccggggaacatcagactggaagaacagtgtcatcagtggctgcatcacgggaggagctattggtttcagagctggcttaaaggctggggccattggttgtggaggttttgctgctttctctgctgcgattgattattacctccggtgagagtaattgcctgcagggaaggatgatgccagccccggatccgggctgctctctggaggacagtttctgtaccacaccagggccttgcttcagggcctgaagacattcattttccctcatgtcgttggtattctgagggagctgcctggcttctctgcctccagcctttggggtagccacactttgctgctcctggactccagccagccttcacagaggacgtcccgtgccagattctctcacagcagatcgggagacaggatgttgacatataggaattcagctccacaaagcttcaggcctgaccacagctggccctctaggttgtttggtgttgtgggcacagaggtgacagtgtctctgcaggcactcaggaagctgttctaccttggaactccatgcaactatccgtctcgaataccagggcagggcaaggcggactgatgccgtccaaccaattatctcacttgttttgtgttctgtcatccttgttttttttttaaaaatacactcccctcccccaccgccacacaccttacagttcaaaaggttggtttatttgtattttattttcaaattccctattccaaaaatagtgccgggtggcccaaagataacatctgaagggaaagaatgagaaagctcccagggaagcgggggatggggcgctgaggcagggttgttagaggactgtgtcatcctcaccaagctcattacatctgccagggcctgcctcaagaagcccagcccagccttttcctgggatgcagtgaaatcccatccatgaactcgatgggcccctcctgtgccggccgagaggcacacactgccttcacgacgtgactgctggacctggccgagcttgaggccacatgtgaagggtcctgctgtggtcatcttggtgactcggtcacagcagctactggccaagatcagacgtcgctgaggggctgttcaccaccatcctcgttctccagggtcaaggaagtgttttaacatgtcgtgttttcgacttgaccttgtggtatttttcttggcctagttgtgtgccatggatattaaaaaaaaaaaaaaaaatccgtctacagttgggcttcagcactggtgctgctttaccctggtgctctgtggggggatgacactgctggagtcaggcctttgctcttgggtggggcacaggcaggtcgcttggtgggggccacacagtgctgggcaccttcagccagtggtgatgagtctcctttttcctataatacggtaattcctctatcctttccttttttgccttcttcctcatctgccctgtcttctggcccacacactcttaaccagcgttcacactcagtgtacatggcctggag

SEQ ID NO: 32985 - DNA, 1602 bp, Homo sapiens
  misc_feature (20)..(20): n is a, c, g, or t
gcctgttcgaggacccaggngaatgtcctatgccaaaaatttcgccattgtgggagccatgttttcttgtactgagtgtttgatagaatcttaccggggaacatcagactggaagaacagtgtcatcagtggctgcatcacgggaggagctattggtttcagagctggcttaaaggctggggccattggttgtggaggttttgctgctttctctgctgcgattgattattacctccggtgagagtaattgcctgcagggaaggatgatgccagccccggatccgggctgctctctggaggacagtttctgtaccacaccagggccttgcttcagggcctgaagacattcattttccctcatgtcgttggtattctgagggagctgcctggcttctctgcctccagcctttggggtagccacactttgctgctcctggactccagccagccttcacagaggacgtcccgtgccagattctctcacagcagatcgggagacaggatgttgacatataggaattcagctccacaaagcttcaggcctgaccacagctggccctctaggttgtttggtgttgtgggcacagaggtgacagtgtctctgcaggcactcaggaagctgttctaccttggaactccatgcaactatccgtctcgaataccagggcagggcaaggcggactgatgccgtccaaccaattatctcacttgttttgtgttctgtcatccttgttttttttttaaaaatacactcccctcccccaccgccacacaccttacagttcaaaaggttggtttatttgtattttattttcaaattccctattccaaaaatagtgccgggtggcccaaagataacatctgaagggaaagaatgagaaagctcccagggaagcgggggatggggcgctgaggcagggttgttagaggactgtgtcatcctcaccaagctcattacatctgccagggcctgcctcaagaagcccagcccagccttttcctgggatgcagtgaaatcccatccatgaactcgatgggcccctcctgtgccggccgagaggcacacactgccttcacgacgtgactgctggacctggccgagcttgaggccacatgtgaagggtcctgctgtggtcatcttggtgactcggtcacagcagctactggccaagatcagacgtcgctgaggggctgttcaccaccatcctcgttctccagggtcaaggaagtgttttaacatgtcgtgttttcgacttgaccttgtggtatttttcttggcctagttgtgtgccatggatattaaaaaaaaaaaaaaaaatccgtctacagttgggcttcagcactggtgctgctttaccctggtgctctgtggggggatgacactgctggagtcaggcctttgctcttgggtggggcacaggcaggtcgcttggtgggggccacacagtgctgggcaccttcagccagtggtgatgagtctcctttttcctataatacggtaattcctctatcctttccttttttgccttcttcctcatctgccctgtcttctggcccacacactcttaaccagcgttcacactcagtgtacatggcctggag

SEQ ID NO: 32986 - DNA, 636 bp, Homo sapiens
ggcacgaggcgagggttgcttgggcagcgactgtcatggcggcggccgcccccaatgccggaggctcggcccctgagacagcgggttccgccgaagctccgctgcagtacagcctgctcctgcagtacctggtgggtgacaagcgtcagccccggctcctggagcctgggagcctgggcgggatcccaagtccagccaagagtgaggagcagaagatgatcgagaaggcgatggaaagctgcgctttcaaggctgcgctggcctgcgtgggaggatttgtcttaggaggtgcatttggggtgtttaccgctggcatcgataccaacgtgggctttgaccctaaggatccttaccgtacaccgactgcaaaagaagtgctgaaagacatggggcagagaggaatgtcctatgccaaaaatttcgccattgtgggagccatgttttcttgtactgagtgtttgatagaatcttaccggggaacatcagactggaagaacagtgtcatcagtggctgcatcacgggaggagctattggtttcagagctggcttaaaggctggggccattggttgtggaggttttgctgctttcttctttgggccccttttgtgccccctgaaaaaatatttttttgggg

SEQ ID NO: 32987 - DNA, 448 bp, Homo sapiens
agtttgagccagtctgaagaacattggaagaccagccccccatcccatcccactcctccccactgcctctacaaaacatttaaaaattagctggtcatgttgctgtgcacctgtggtcccatctacttgggaggctgattactcccctgccatcgcttgagccccgggagtggaggctgcaatgagctatggttacaccacaggctgaaaaaaacataaatgcattcaaatgcagatatcaaaatattaaagatgcaatttatgacattaacatgtgcttcttcaccctcaggtttattaaggtatgattgacaaaattgtatatatttatggtgtacagcatgatgttttgatatctgtatgtattgtgaaatgaccaagtcaagctaatttaaatataattatctcacgtacttattattattattttgagacagagtctcgctct

SEQ ID NO: 32988 - DNA, 475 bp, Homo sapiens
gatccctcaagatacccattggaaaggttcattggctgtcctgctctccccctcaggagctctaagtcaagatgcacatctacgcataggccacattcccaaggtcagtgatgtgtgggctagggcttgttttagagactgtgacacctggaattactcaagatggcctgatgccagggtgctatggtttggctgtgttcccacccaaatctcatctggaattttatttcccataatccacgcatgtggtgggagggacccagtgggaggcaatttaatcatggtgggtggcttccctcatcctgttcatgtgacagtgagttagttctcacaaaatctgatgtttttataaggggcttcccccttagctgggcttttattcttctccttcctgccaccatgtggaaaaggacatatttactttcccctccaccatgattgtaagtttcctgaggcctcctcaaccttgtggaac

SEQ ID NO: 32989 - DNA, 361 bp, Homo sapiens
ttaagactcatggctttactgtaatatgttttgaattgatcattccagttctggcttggccttttcaacagattcaggtctatatttctgcaaaagtttctgggattatagttttaaatattctgcttcgttgttttgcttttcttctgggactccaattatgtttacgttgggcctgcttagctatcttttatttcagtcactttgacttcaacccttttatatttatatacacatacacacacacacacacacacacagacacacacacacacacacacacacacacacacacacgcatttttaccccaaatacttatttgacagtatttgtttttgttttttgaagacagggtcttgc

SEQ ID NO: 32990 - DNA, 393 bp, Homo sapiens
catacaggtaaaaccaaactgtaattgaagtgtatccccagaaagctatgggacctcttataactaatgatagtcaccccagtcaccccaggattttatcggcttatcaatttgtacaacatagataataaattaatgataaagtataattcatgtaatgattctatttgacttcactagaaaccatatttatttgccaattcattttcgaggtgacagttggttaagtcacattcatattgtctgtcagctcataactataaattttataaattaattggcagacatactctgtatatggttccaaaatatggcttttgcttaataatttgtagaagactatttagaatgtataaggagctggtaaatatatttggataaaagggctttctt

SEQ ID NO: 32991 - DNA, 528 bp, Homo sapiens
agtgatagagggcattgcggcagagaaaaaccctgtgaacaactgtcttgctggtttgatgaatatttaatgtgctcctactggtttaggatgctaggttcatctaaatgtgcataactacttttagggtcttaaatgcccccttgctttctggagacaattaaaattttaaatcctgtaaacagttttgttacatgcaaagaatacttgtgtagatcacctgaaactgtttcccaccaattgttgtttgggaaagactgttgtatttgaaatactagaacaggtgagtgaggtagaacatagtacagattctctctagcatgaggttatgtggggctcaacggaatggtagagcatggggtctgaggctgtagaaagagtaaggtattttagaatgaaaatctttgtgggtatggctgggcacagtggctcacgcctgtaatatcagcactttgggaggcttaggcgagtggatcacctgaggtcaggagaccagcctggttaacacggttaaaccccatgattact

SEQ ID NO: 32992 - DNA, 337 bp, Homo sapiens
cttggctatgtccaagtggaagcaaattttaatgctcggtctcagaagaaaatttcacatatacaggcttcagaggtaacggggtaaccgatagcttccttttacttctcggcatttatttttgcttttctgaagcatagtcctatgtttattaaagggaccacaggagtacacgctgtttgaaagccatttctggacaccactgaggccggctttcccaggagcctttgtcgcctctgcagcagaagtcactggactctcctcaaggtgtaatgtgagggaacaggtgcctcgggggcttgggaaaacaccacgctgtgctctgatgtgtgtcccc

SEQ ID NO: 32993 - DNA, 583 bp, Homo sapiens
cacgaagagggcaaaataattatagtcttgtagcctgtatcttgagaatgatgcctagggtgttatccctaaatggtcctgtggctagccaagaattaggaggtttcttgttgcctgatactgactataagattaactgaatcttttttttcttgtggtaaaatatatatgacataaaatttactgtttttaagtgtatagctcagtggcactaaatacactcatattgctctacaaccatcaccttaaaactctctactcattaaacaataggtccccagtctctccttccaccagcccctgggaccactgttctactttctgtgtctgtgaatttgactacgctaagtactcatgtaagtggaattatacaatatttgccctttgtaactgacttgtttcacttagcataatgttttcaacttcatccaagtggtggcatgtgccaggatttccttcctttttaaggctaatattccattgcatgtatataccacattttgtttatctactcacctgttgatggacatttgggctattatgaataaatgttgctacaagcattggtgtacaaacatccatt

SEQ ID NO: 32994 - DNA, 473 bp, Homo sapiens
cggtgaaccccaaaagggaatgaagcacaaagtgtacacattttcaaaagtaatcatggcagtaagtgtcctaagataccctgagctgtccttaaggataaattttacagtggatgccaagaaaaaaacaggtttagagacaaacttggaatgtgtttcactgcaccttagatttcccttcggcaagaagaggtgacctacatcctagcactggtgggggggagtatcatggtcttgtacaaagtaggggggcttgggagttggaaggggattcagatccagctctgtggctgaccagctgtgatattttagtgatgttaatctttcttgtaaaggcattgcattgggttggatagtgccattctcccaaagggccctttcagcccaaatctaccttaagactacctattatgttcattaatgagtgattaccaggcatccaaggacttctgtgactttcccttgccaggccc

SEQ ID NO: 32995 - DNA, 1040 bp, Homo sapiens
  misc_feature (61)..(61): n is a, c, g, or t
  misc_feature (105)..(105): n is a, c, g, or t
  misc_feature (308)..(308): n is a, c, g, or t
  misc_feature (452)..(452): n is a, c, g, or t
  misc_feature (770)..(770): n is a, c, g, or t
  misc_feature (908)..(908): n is a, c, g, or t
atgccctgcccctggccctacgcccctacctccggagcgagttttccccatcggtggacgngcggccctgcagcagtccctcagagctacctgcgaagctgcttntgggggccactcttcctcgggccccgcggctgccgcgccggctggcctggtgctccattgactgggagcaggtgtgcttgctgcagaggctgggagctggagggtttggctcggtgtacaaggcgacttaccgcggtgttcctgtggccataaagcaagtgaacaagtgcaccaagaaccgactagcatctcggcggagtttntgggctgagctcaacgtagcaaggctgcgccacgataacatcgtgcgcgtggtggctgccagcacgcgcacgcccgcagggtccaatagcctagggaccatcatcatggagttcggtggcaacgtcactttacaccaagtcatntatggcgccgccggccaccctgagggggacgcaggggagcctcactgccgcactggaggacagttaagtttgggaaagtgtctcaagtactcactagatgttgtgaacggcctgctcttcctccactcgcaaagcattgtgcacttggacctgaagcccgcgaacatcttgatcagtgagcaggatgtctgtaaaattagtgacttcggttgctctgagaagttggaagatctgctgtgcttccagacaccctcttaccctctaggaggcacatacacccaccgcgccccggagctcctgaaaggagagggcgtgacncctaaagccgacatttattcctttgccatcactctctggcaaatgactaccaagcaggcgccgtattcgggggagcggcagcacatactgtacgcggtggtggcctacgacctgcgcccgtccctctccgctgccgtnttcgaggactcgctccccgggcagcgccttggggacgtcatccagcgctgctggagacccagcgcggcgcagaggccgagcgcgcggctgcttttggtggatctcacctctttgaaagctgaactcggctga

SEQ ID NO: 32996 - DNA, 2151 bp, Homo sapiens
gccaaaagaagcctctgggaaggtgtgccaatggtgaaaacgtacagagggtcagggtgaagcagtgatctctattggttgaaaaactgatcaggtcatatgatgattgaagtatgtttattgtaagggcagaaatgtgttggcatttggataaaaaactgctaacattatagaacttattacctaacaaaatttcacaccacaaaaaatattttaatggcaaattcaaggtgttttattgcttacaaatcagcatctttgactctttgaacatcaatttgtgtttacattgaaatgacaaaaagacaaactaagaagaaatacagcatgcaagttggaattcagagttaaaaccatgatgttgccgctcagccagctatgtgactgttgaccctttcaagaacacacatggatttaaaagttggatgacatccattgttggggccttgggggatatggtaaagcatgaaaactaaacagccaggagcctgtgaaatctgctactgtattttccaggacttcattccactccttggctaaaaaaatcttggaagtttcacagattatgatgtggacctgtcacctgtaaattgtctcaatctactcagacaagacactaaactgtctttggatactatagatgtcagtgcttatagcagctggaatttggctagtgacaatgtttaaagatgtaatactagttagtatctattgaagcttaaactttgctggtcaggttgtagctattgtaaaagtatttattgaagaagctcacagtccttcagttgtacagactgaaaaactttcatgaaagatccaacatactaatgtaaattatatttattacaatgtatgatattaatgtgtcaaactggtgtattttacaaaatatataatgcatacataaataagagttgtatattacagtgcttttcaaatatcagtgtcttggaatatttaagtcttcacattttttggtctaaaatatgaaaatgtttcatgatacaagtgattaattttccctagtagtgcttttgcatgtttgcctttttatttaagtttttttctatatagacacaatttggtgtcagactatcataagatcgatagtgaatataaaatatcttagccaaatggggtctgtattgtctacattttatatattaaataaaagtttttgttgtcttttcaggaggtttagagtattgtcactaaatatgatcaaagcttccctttccaaatgcaaaagtcttgtcctacatttaaagttgatctgtcatgttttagcagtcaagtgggatgggcattatataaacaacgttacaatgtaaggaaaatctttaaggagatggggagagaaaaaggcagctggtataatcggttactgctgcttagttctacttaattttttgtgttgcttcttcttaaggtgagatagcataatcttaactgttttgagatggaattttaaagtaacacactaccagcgagttcaacactgctattgattttaatctgtttttttttgtttagttgataacttaaattccaagtttcatagtgataattgtatattatttggctgctgaattctgttagagttttttattctgttgtacattgtattatacacataatcacaaattaatatgaaggtgaatatatgttacatatcaaaatttgtgaatttgaattatagtatgttttagtgctattgcaaaaaatgtttatttttatattatctgtgattttaatatagatgattgaactagatttctttttgagtgatagtgccattgaatgagcagtatggaaacagtgttacttgatattttgagctttctcaggtttatctaaatcagtggtagcttaacaaaacccagactaattgtgtgtaattgtatttttaataaaaggaaagtacatttcctataatagcatagtactgtttgcatgtaagagtatgcaaaaccttgtgtgtgtgtgtgtgtgtgtgtgtgtgtgtgtgtcttagtgtgtgtaaggcatggcagccaactttgtatctgctatttttagtacgagcagagcttcataattgtggtcactagaactgtacttaccatggacagttaaaactgaaaaagactcaataaaactatgaaacatggt

SEQ ID NO: 32997 - DNA, 396 bp, Homo sapiens
ctgcccaggaattaaagaggcaataaattatcttagttactattagaaaaggggagcttgttaatattgtgacatcattattacctgaggtgtcctgtactggtagagccattaaacaaaaatcttgctcctccattgccttaagtaagtttctatttagtattgtaaatggatggaataatgaccacagaaacactctgacagtgctgaggaataattgttcctgcatttaatatcatttgaaaattttgacgaccaattttaagtgatttttagtaattaaatttttatttatttttttgaggagagaaatggtctctgtcacctagtctagagtgcagtggtgctaccatggctcacggcagcctcatcctcctgggctaaagggatcctccc

SEQ ID NO: 32998 - DNA, 256 bp, Homo sapiens
ttgactcttgtgtgttggggagtggggcaggggggtgggctggggccaagggccagggaggacaatttggtcctgactctcttatttggggtctttatggatctgctctaacaccagccagttagagccaggagactgcaagctgggacctgtgcattgatcaggtatgcctgaggccaatggtgaagggaggatggaccctttgaatccagttatttggctctctgggctcctgccctgaggttccctccagccc

SEQ ID NO: 32999 - DNA, 469 bp, Homo sapiens
taagatttacccgtatgtttccttctaagagttttacagtcgtaactcttacgtttaagtcatcaattcatttttgaattaatttttgcatatggtgtgatggagggtccaacttcattttttttttcatgtgactatctgattatcccagacctatttgttgaaaagaatggtcttgttgacctttttgaaaatcatttgggctggatgtggtggctgatgcctataatcgcagcactttagtgtgatggagggtccaacttcattttttttttcatgtgactatctgatcatcccagacctatttgttgaaaagaatggtcttgttgacttttttgaaaatcatctgggctggatgtggtggctcatgccagttatcccagcactttgggaggccacagtgggaggattgcttgagcccagaagttgaagaccagcctgggcaacatggtgagattctatctctaca

SEQ ID NO: 33000 - DNA, 1095 bp, Homo sapiens
ttcatgtggggaagacaatctggcattcttgttgatcttggtatgagaaactgtactaatacttgcataattttgagtcaaattactagagcactgtgaatatcttacataaataaacgtagtacaaatgtatctaaattctgcaggacttaagagcaacgggaggcaacttttttgaaaatctgttaagtcgtgataaatctcaataaggagatgaaacaatgtattaatctggtgaaatttcacatttttaataggtctgcttttcaaaagtaagaatcaagttaactatgagggacatcataatgaagtttcgtggcacaacacgagtcacagaggcactgtcttaagacagtctctctgatctgtaacttgtaaacaatattttgaaataagctactcatacattccattatttgtttcctaactaaaaatatttacatgtctttaatacaccaaacaccttgcctttgcccactcaaaagattgagatgtcaataaagatgaggcctaggaatttgggggttaagtggaaaagagataattatcttatttggaattaacttgctaactcaggtgaaaattcccttacccctgccaccaaataagacagtattctattatgtctccctttgactcctaacacccaactaagaaggactaactctgaatgtccttcctttttaatcaatacctaaggactcactgctccttccccaagaaaagaacagtgaaggcctgacaggcaataaccccgaataccctcaaaagtgtgggccttcgagcagcactgctcttgggatccagttaccacctttccccttcccccaacccacttcccgggttttctcaggctcggcctgctccctccccaccccacagccacatttccagctgcggccaccgcctcgggttctcttgtgagcttccatccctccgaggagttgccccctgtccatcacctccccaaaccatgttccaccccagaccacccgcccgcgagaccgtccatcctagcgctctgggaggggaggggaaggcggcggaaggaggaggggaacactgctgcttcctcacaggcagaagggcggccgc

SEQ ID NO: 33001 - DNA, 793 bp, Homo sapiens
ctttcaaccttcagatgaaagaagcaggtctagagaagtgttgcttccttcactctgatccaaatggggagtcaaccaggcaccagggctcaatcaacagcaataaacatcactgtctgaggtcaactggcttgctcagctctctgttatcaggcactgccaccagcagcacttctatcagagtgcgagctcctcaaggttaaaggcatttgagaagggcttaccaagagtccagacactagacaaagttacttgtgcagtctgctttcagacactgggaatgaagtcttcctccctaccaccaaacttggggggaaaaaacaaaaaaaaacctctaatccaatccttggtctgcaggtaagctaaagtgcagattcctgaggaggatcacagaaacttcagtactctggtctacctttcagtgtgaatgagttccagccctattcttgaaaattgttattggaacagagcaggtaggccctgaggcatattgaagggagttaatgattatggagtgatgcagggtgcctgacagcattggacaggagggtatgttttctcatgttggtctcacaataactatgtagagccactcttacccccattgtacagatgaggaaactgttgccttaaaatacaatttttttgtaataaagtcatgctaatttgtttacatattgtctatagttgctttcactggcaaaacctaaaatgtttactatctggccctttctagaatgtttgctgaccttgttctgaattcttcaagctctaaatttacctctgtagagaa

SEQ ID NO: 33002 - DNA, 334 bp, Homo sapiens
catgctggaaaagcagcaggaaacacgagaaagtgcatgctcacacccttatgcttttgtatctactatttctgcacttggtgctgtctttctttcaggaaaatatttgattttcctttaaagctcagctcaaatgttcttttctccaaaactttccctgacgaccaaccttcccctacaaaagcagaactgacatctcttcttattgctgtcagtatctctgtttattgagagctgcttgtgtgctggcactgagtagacagcaaattaaattactgcatttaattcttatgacaactccttatggttgcttttattattgttcccattttat

SEQ ID NO: 33003 - DNA, 1027 bp, Homo sapiens
aacggtagcatccgtttttccgcgcccgcggccttgaaggggtggtggtcgacgggcaagtagagaccgcgagggtctggaggggcgaccggcctggcacagaggggaaggaagagagcgggatgctaagtgccgtctggggagccggagggcccggggcgggcggggctgctcgaggacagccgagcagaaaagaattgctgctgaggcaccacctttggagcggtcctcgctgcctgtccttcccgctgggctcactccccgcgtctctcctggggcttcctggagccacttcccacaggagctgcttgtccccaaatcttgcctcaggacttgctgccaggggaacgcagactcagagcgtcctctttggagaagtaaggctgcctctggacggaggagtgaggggggcgaggaaacgcagtcttctgagagcacaccccaggactgggattttgccaggaagatgtggaatggtgtggaaagacaagaagctgcagccttcaggctgccatgaaaaagctgggggtgtgttctgtggcccatcaagagggggtgtgtaatgaattgttaatgaatttctcagatgagccaaagtggtgaacttgtctcagtacccagggagactcagactcatccccagctcttggcctccattttcccagctgctgtgattggagtgggtccctggaattcatatgctggaaatttggtccaggtgtgggtgtgttgggaggtggggtttaaggtgtggttaggccattaagagattaatgctgctctttagggactgggctaattcttgagggagtgagtggcttcccgctctctccggacagcattaactgccacaggttgggttattataacatgaggccacccctcatgttttgtcccactcccccttccacttcgcttctgtgtcatgatgcaggacaaaagcaccaccagaaactgttgccgttctcttgggcttcccagccttcaaaactgagtcaagtaaacatctttcctgtataaatcataa

SEQ ID NO: 33004 - DNA, 587 bp, Homo sapiens
aacggtagcatccgtttttccgcgcccgcggccttgaaggggtggtggtcgacgggcaagtagagaccgcgagggtctggaggggcgaccggcctggcacagaggggaaggaagagagcgggatgctaagtgccgtctggggagccggagggcccggggcgggcggggctgctcgaggacagccgagcagaaaagaattgctgctgaggcaccacctttggagcggtcctcgctgcctgtccttcccgctgggctcactccccgcgtctctcctggggcttcctggagccacttcccacaggagctgcttgtccccaaatcttgcctcaggacttgctgccaggggaacgcagactcagagcgtcctctttggagaagaagctgaaagcacaaccagtaccttctcaggagcgtggggaggccagccacccgggcagagcaaggagagaatgaggagtgacatgggtgttgccgtgagtggcgaaggggatggaagatttcagcacgatgctatttctaacaagtttcagcattccagtatctcttttcacaaataaaacatttactaaccatttgagcgtattccc

SEQ ID NO: 33005 - DNA, 378 bp, Homo sapiens
cacctgtagttccagctgtgtgggagggtgaggcaagaggatcgcttgaacctaggattttgaggctgcagtgagttatgattgtgccacttaatgtcagcttcggtgacagcgagaccctgtctcaaaaaaaaagttttcgtacatacccaactatctaccaatcaggaagctgaaagcacaaccagtaccttctcaggagcgtggggaggccagccacccgggcagagcaaggagagaatgaggagtgacatgggtgttgccgtgagtggcgaaggggatggaagatttcagcacgatgctatttctaacaagtttcagcattccagtatctcttttcacaaataaaacatttactaaccatttgagcgtattccc

SEQ ID NO: 33006 - DNA, 2526 bp, Homo sapiens
cgccgcccgctgctggccagccccgggcccgggactcgggcgatgtccgctcgcagccgcgccccctgtttcagtggagcaagtggaagaagaggatgggctcgtccatgtcggcggccaccgcgcggaggccggtgtttgacgacaaggaggacgtgaacttcgaccacttccagatccttcgggccattgggaagggcagctttggcaaggtgtgcattgtgcagaagcgggacacggagaagatgtacgccatgaagtacatgaacaagcagcagtgcatcgagcgcgacgaggtccgcaacgtcttccgggagctggagatcctgcaggagatcgagcacgtcttcctggtgaacctctggtactccttccaggacgaggaggacatgttcatggtcgtggacctgctactgggcggggacctgcgctaccacctgcagcagaacgtgcagttctccgaggacacggtgaggctgtacatctgcgagatggcactggctctggactacctgcgcggccagcacatcatccacagagatgtcaagcctgacaacattctcctggatgagagaggacatgcacacctgaccgacttcaacattgccaccatcatcaaggacggggagcgggcgacggcattagcaggcaccaagccgtacatggctccggagatcttccactcttttgtcaacggcgggaccggctactccttcgaggtggactggtggtcggtgggggtgatggcctatgagctgctgcgaggatggaggccctatgacatccactccagcaacgccgtggagtccctggtgcagctgttcagcaccgtgagcgtccagtatgtccccacgtggtccaaggagatggtggccttgctgcggaagctcctcactgtgaaccccgagcaccggctctccagcctccaggacgtgcaggcagccccggcgctggccggcgtgctgtgggaccacctgagcgagaagagggtggagccgggcttcgtgcccaacaaaggccgtctgcactgcgaccccacctttgagctggaggagatgatcctggagtccaggcccctgcacaagaagaagaagcgcctggccaagaacaagtcccgggacaacagcagggacagctcccagtccgagaatgactatcttcaagactgcctcgatgccatccagcaagacttcgtgatttttaacagagaaaagctgaagaggagccaggacctcccgagggagcctctccccgcccctgagtccagggatgctgcggagcctgtggaggacgaggcggaacgctccgccctgcccatgtgcggccccatttgcccctcggccgggagcggctaggccgggacgcccgtggtcctcaccccttgagctgctttggagactcggctgccagagggagggccatgggccgaggcctggcattcacgttcccacccagcctggctggcggtgcccacagtgccccggacacatttcacacctcaggctcgtggtggtgcaggggacaagaggctgtgggtgcaggggacacctgtggagggcatttcccgtgggcccccgagacccgcctagatggaggaagcgctgctgggcgccctcttaccgctcacggggagctggggccatggatgggacaggagtctttgtccctgctcagcccggaggctgtgcacggccctcgtcacaaggtgacccttgcagcacaggccgcgggtgccccaggctcggctcagttcttggaggtcaagggcatgggttggggtagtgggtggggaggtgaatgttttctagagattcaaactgctccagcaatttctgtatagttttcacctctgagaattacaatgtgagaaccgctaaaaaaaaaaaaaaaaaaaaaaaaaaaaaaaaaaaaaaaaaaaaaaaaaaaaaaaaaaaaaaaagggggggggggccaaaaaataccccccggggggccccctcccccccccgtttttttgacagggggcgccccccaataggggaggagccgctaatataaaacgagcgagacgagcgcggcgccgctatcaaccacaccggcgggggaggaggaaaccaccgagcctcccggggacgaaccacctgggaacagcaccccccaccctgcggggggggccaaccaatgtgggcccacccactcccggcaggaagtaatttaacgcgcccagcggcacaaccaacaccctgacggggtctagtgcgggcgcacacccgcggtactatgtgccgcggcaacaaaaattctggcccacgcgatttacgcttccaggcaatttaacagcagggcgagaagaacaaaccgccccacgacccaccaacgaccaccccccgcaaccgccccgacgcggcacccccaccacgcccaccatcaaccgccgccacgccacggaccacacgccacacacaccactgccaccaccacacgccgccctccacacccccggcgcccgaaccaccgccacgccgccaccgccacgccaccggcccc

SEQ ID NO: 33007 - DNA, 2666 bp, Homo sapiens
tttgtactttgcagttagagaggcgctcacctgtgccgcccgagtgcgagtgaggctcctgccccacaggtggcggggcccggccgctcagaggctcagtctccttggtgaccgcgcggtgtccatcctctgctcacccatgtgcgctggaggcagggccaggccgttgtgcaaagacctgccctgccaggaacgagtgcgctgctgagtcctgtagataaagccgccaaccccggggactggtgtctcctgagtgaccgtgcagccgtgggcgccatagaaagcagagaaggcagtgaacttcgaccacttccagatccttcgggccattgggaagggcagctttggcaaggtgtgcattgtgcagaagcgggacacggagaagatgtacgccatgaagtacatgaacaagcagcagtgcatcgagcgcgacgaggtccgcaacgtcttccgggagctggagatcctgcaggagatcgagcacgtcttcctggtgaacctctggtactccttccaggacgaggaggacatgttcatggtcgtggacctgctactgggcggggacctgcgctaccacctgcagcagaacgtgcagttctccgaggacacggtgaggctgtacatctgcgagatggcactggctctggactacctgcgcggccagcacatcatccacagagatgtcaagcctgacaacattctcctggatgagagaggacatgcacacctgaccgacttcaacattgccaccatcatcaaggacggggagcgggcgacggcattagcaggcaccaagccgtacatggctccggagatcttccactcttttgtcaacggcgggaccggctactccttcgaggtggactggtggtcggtgggggtgatggcctatgagctgctgcgaggatggaggccctatgacatccactccagcaacgccgtggagtccctggtgcagctgttcagcaccgtgagcgtccagtatgtccccacgtggtccaaggagatggtggccttgctgcggaagctcctcactgtgaaccccgagcaccggctctccagcctccaggacgtgcaggcagccccggcgctggccggcgtgctgtgggaccacctgagcgagaagagggtggagccgggcttcgtgcccaacaaaggccgtctgcactgcgaccccacctttgagctggaggagatgatcctggagtccaggcccctgcacaagaagaagaagcgcctggccaagaacaagtcccgggacaacagcagggacagctcccagtccgagaatgactatcttcaagactgcctcgatgccatccagcaagacttcgtgatttttaacagagaaaagctgaagaggagccaggacctcccgagggagcctctccccgcccctgagtccagggatgctgcggagcctgtggaggacgaggcggaacgctccgccctgcccatgtgcggccccatttgcccctcggccgggagcggctaggccgggacgcccgtggtcctcaccccttgagctgctttggagactcggctgccagagggagggccatgggccgaggcctggcattcacgttcccacccagcctggctggcggtgcccacagtgccccggacacatttcacacctcaggctcgtggtggtgcaggggacaagaggctgtgggtgcaggggacacctgtggagggcatttcccgtgggcccccgagacccgcctagatggaggaagcgctgctgggcgccctcttaccgctcacggggagctggggccatggatgggacaggagtctttgtccctgctcagcccggaggctgtgcacggccctcgtcacaaggtgacccttgcagcacaggccgcgggtgccccaggctcggctcagttcttggaggtcaagggcatgggttggggtagtgggtggggaggtgaatgttttctagagattcaaactgctccagcaatttctgtatagttttcacctctgagaattacaatgtgagaaccgctaaaaaaaaaaaaaaaaaaaaaaaaaaaaaaaaaaaaaaaaaaaaaaaaaaaaaaaaaaaaaaaagggggggggggccaaaaaataccccccggggggccccctcccccccccgtttttttgacagggggcgccccccaataggggaggagccgctaatataaaacgagcgagacgagcgcggcgccgctatcaaccacaccggcgggggaggaggaaaccaccgagcctcccggggacgaaccacctgggaacagcaccccccaccctgcggggggggccaaccaatgtgggcccacccactcccggcaggaagtaatttaacgcgcccagcggcacaaccaacaccctgacggggtctagtgcgggcgcacacccgcggtactatgtgccgcggcaacaaaaattctggcccacgcgatttacgcttccaggcaatttaacagcagggcgagaagaacaaaccgccccacgacccaccaacgaccaccccccgcaaccgccccgacgcggcacccccaccacgcccaccatcaaccgccgccacgccacggaccacacgccacacacaccactgccaccaccacacgccgccctccacacccccggcgcccgaaccaccgccacgccgccaccgccacgccaccggcccc

SEQ ID NO: 33008 - DNA, 2431 bp, Homo sapiens
atccaatttttggatacccatatgcccgggtattcaaaacagcgtgtcgacgttcggtgactagctctcgtcgccgcccgacggactgtacatgctgttgcctgtgagcacgcgccgtttgagaagagggtactcactgcatttctcagcactgaatcgggttgcatagttgactgtactacggactgagacatgtgacattaattacatctatgtttcatgcactatctagttcagtaggaatcttgtatgacattttctgtgactctgtactccttccaggacgaggaggacatgttcatggtcgtggacctgctactgggcggggacctgcgctaccacctgcagcagaacgtgcagttctccgaggacacggtgaggctgtacatctgcgagatggcactggctctggactacctgcgcggccagcacatcatccacagagatgtcaagcctgacaacattctcctggatgagagaggacatgcacacctgaccgacttcaacattgccaccatcatcaaggacggggagcgggcgacggcattagcaggcaccaagccgtacatggctccggagatcttccactcttttgtcaacggcgggaccggctactccttcgaggtggactggtggtcggtgggggtgatggcctatgagctgctgcgaggatggaggccctatgacatccactccagcaacgccgtggagtccctggtgcagctgttcagcaccgtgagcgtccagtatgtccccacgtggtccaaggagatggtggccttgctgcggaagctcctcactgtgaaccccgagcaccggctctccagcctccaggacgtgcaggcagccccggcgctggccggcgtgctgtgggaccacctgagcgagaagagggtggagccgggcttcgtgcccaacaaaggccgtctgcactgcgaccccacctttgagctggaggagatgatcctggagtccaggcccctgcacaagaagaagaagcgcctggccaagaacaagtcccgggacaacagcagggacagctcccagtccgagaatgactatcttcaagactgcctcgatgccatccagcaagacttcgtgatttttaacagagaaaagctgaagaggagccaggacctcccgagggagcctctccccgcccctgagtccagggatgctgcggagcctgtggaggacgaggcggaacgctccgccctgcccatgtgcggccccatttgcccctcggccgggagcggctaggccgggacgcccgtggtcctcaccccttgagctgctttggagactcggctgccagagggagggccatgggccgaggcctggcattcacgttcccacccagcctggctggcggtgcccacagtgccccggacacatttcacacctcaggctcgtggtggtgcaggggacaagaggctgtgggtgcaggggacacctgtggagggcatttcccgtgggcccccgagacccgcctagatggaggaagcgctgctgggcgccctcttaccgctcacggggagctggggccatggatgggacaggagtctttgtccctgctcagcccggaggctgtgcacggccctcgtcacaaggtgacccttgcagcacaggccgcgggtgccccaggctcggctcagttcttggaggtcaagggcatgggttggggtagtgggtggggaggtgaatgttttctagagattcaaactgctccagcaatttctgtatagttttcacctctgagaattacaatgtgagaaccgctaaaaaaaaaaaaaaaaaaaaaaaaaaaaaaaaaaaaaaaaaaaaaaaaaaaaaaaaaaaaaaaagggggggggggccaaaaaataccccccggggggccccctcccccccccgtttttttgacagggggcgccccccaataggggaggagccgctaatataaaacgagcgagacgagcgcggcgccgctatcaaccacaccggcgggggaggaggaaaccaccgagcctcccggggacgaaccacctgggaacagcaccccccaccctgcggggggggccaaccaatgtgggcccacccactcccggcaggaagtaatttaacgcgcccagcggcacaaccaacaccctgacggggtctagtgcgggcgcacacccgcggtactatgtgccgcggcaacaaaaattctggcccacgcgatttacgcttccaggcaatttaacagcagggcgagaagaacaaaccgccccacgacccaccaacgaccaccccccgcaaccgccccgacgcggcacccccaccacgcccaccatcaaccgccgccacgccacggaccacacgccacacacaccactgccaccaccacacgccgccctccacacccccggcgcccgaaccaccgccacgccgccaccgccacgccaccggcccc

SEQ ID NO: 33009 - DNA, 633 bp, Homo sapiens
aacggtagcatccgtttttccgcgcccgcggccttgaaggggtggtggtcgacgggcaagtagagaccgcgagggtctggaggggcgaccggcctggcacagaggggaaggaagagagcgggatgctaagtgccgtctggggagccggagggcccggggcgggcggggctgctcgaggacagccgagcagaaaagaattgctgctgaggcaccacctttggagcggtcctcgctgcctgtccttcccgctgggctcactccccgcgtctctcctggggcttcctggagccacttcccacaggagctgcttgtccccaaatcttgcctcaggacttgctgccaggggaacgcagactcagagcgtcctctttggagaagtaaggctgcctctggacggaggagtgaggggggcgaggaaacgcagaagctgaaagcacaaccagtaccttctcaggagcgtggggaggccagccacccgggcagagcaaggagagaatgaggagtgacatgggtgttgccgtgagtggcgaaggggatggaagatttcagcacgatgctatttctaacaagtttcagcattccagtatctcttttcacaaataaaacatttactaaccatttgagcgtattccc

SEQ ID NO: 33010 - DNA, 743 bp, Homo sapiens
aacggtagcatccgtttttccgcgcccgcggccttgaaggggtggtggtcgacgggcaagtagagaccgcgagggtctggaggggcgaccggcctggcacagaggggaaggaagagagcgggatgctaagtgccgtctggggagccggagggcccggggcgggcggggctgctcgaggacagccgagcagaaaagaattgctgctgaggcaccacctttggagcggtcctcgctgcctgtccttcccgctgggctcactccccgcgtctctcctggggcttcctggagccacttcccacaggagctgcttgtccccaaatcttgcctcaggacttgctgccaggggaacgcagactcagagcgtcctctttggagaagtaaggctgcctctggacggaggagtgaggggggcgaggaaacgcagtgagtgtcctgaggaagggttttgagaatttggaagaagatgaaatgacaccgggcgggaggggaggtgctcgcgtggtcctgtggaaccctggagtcccgtgcaccttcattccaggatccaactgataatgaaaagtagcaccctctgtcccacccagaaacactctggaaacccggacagtttagctggagtctgccatgatttcactttttttttgttttttttttcgggggggggagtctggcttggtctcccgggttggattgcatagcgcgatctcggcccattgggacctcggcctccggggttcaagcaa

SEQ ID NO: 33011 - DNA, 654 bp, Homo sapiens
aacggtagcatccgtttttccgcgcccgcggccttgaaggggtggtggtcgacgggcaagtagagaccgcgagggtctggaggggcgaccggcctggcacagaggggaaggaagagagcgggatgctaagtgccgtctggggagccggagggcccggggcgggcggggctgctcgaggacagccgagcagaaaagaattgctgctgaggcaccacctttggagcggtcctcgctgcctgtccttcccgctgggctcactccccgcgtctctcctggggcttcctggagccacttcccacaggagctgcttgtccccaaatcttgcctcaggacttgctgccaggggaacgcagactcagagcgtcctctttggagaagtaaggctgcctctggacggaggagtgaggggggcgaggaaacgcagaagctgaaagcacaaccagtaccttctcaggagcgtggggaggccagccacccgggcagagcaaggagagaatgaggagtgacatgggtgttgccgtgagtggcgaaggggatggaagatttcagcacgatgctatttctaacaagtttcagcattccagtatctcttcaactaaaaaacaggatgcggccgtggccttggcttttaaaatatttaaagtaaaattggat

SEQ ID NO: 33012 - DNA, 2854 bp, Homo sapiens
aacggtagcatccgtttttccgcgcccgcggccttgaaggggtggtggtcgacgggcaagtagagaccgcgagggtctggaggggcgaccggcctggcacagaggggaaggaagagagcgggatgctaagtgccgtctggggagccggagggcccggggcgggcggggctgctcgaggacagccgagcagaaaagaattgctgctgaggcaccacctttggagcggtcctcgctgcctgtccttcccgctgggctcactccccgcgtctctcctggggcttcctggagccacttcccacaggagctgcttgtccccaaatcttgcctcaggacttgctgccaggggaacgcagactcagagcgtcctctttggagaagtaaggctgcctctggacggaggagtgaggggggcgaggaaacgcatgaacttcgaccacttccagatccttcgggccattgggaagggcagctttggcaaggtgtccccacgtgtccccaggcgtcctcaggcgtcctgccgaacagccctgtgccctccaggtgtgcattgtgcagaagcgggacacggagaagatgtacgccatgaagtacatgaacaagcagcagtgcatcgagcgcgacgaggtccgcaacgtcttccgggagctggagatcctgcaggagatcgagcacgtcttcctggtgaacctctggtactccttccaggacgaggaggacatgttcatggtcgtggacctgctactgggcggggacctgcgctaccacctgcagcagaacgtgcagttctccgaggacacggtgaggctgtacatctgcgagatggcactggctctggactacctgcgcggccagcacatcatccacagagatgtcaagcctgacaacattctcctggatgagagaggacatgcacacctgaccgacttcaacattgccaccatcatcaaggacggggagcgggcgacggcattagcaggcaccaagccgtacatggctccggagatcttccactcttttgtcaacggcgggaccggctactccttcgaggtggactggtggtcggtgggggtgatggcctatgagctgctgcgaggatggaggccctatgacatccactccagcaacgccgtggagtccctggtgcagctgttcagcaccgtgagcgtccagtatgtccccacgtggtccaaggagatggtggccttgctgcggaagctcctcactgtgaaccccgagcaccggctctccagcctccaggacgtgcaggcagccccggcgctggccggcgtgctgtgggaccacctgagcgagaagagggtggagccgggcttcgtgcccaacaaaggccgtctgcactgcgaccccacctttgagctggaggagatgatcctggagtccaggcccctgcacaagaagaagaagcgcctggccaagaacaagtcccgggacaacagcagggacagctcccagtccgagaatgactatcttcaagactgcctcgatgccatccagcaagacttcgtgatttttaacagagaaaagctgaagaggagccaggacctcccgagggagcctctccccgcccctgagtccagggatgctgcggagcctgtggaggacgaggcggaacgctccgccctgcccatgtgcggccccatttgcccctcggccgggagcggctaggccgggacgcccgtggtcctcaccccttgagctgctttggagactcggctgccagagggagggccatgggccgaggcctggcattcacgttcccacccagcctggctggcggtgcccacagtgccccggacacatttcacacctcaggctcgtggtggtgcaggggacaagaggctgtgggtgcaggggacacctgtggagggcatttcccgtgggcccccgagacccgcctagatggaggaagcgctgctgggcgccctcttaccgctcacggggagctggggccatggatgggacaggagtctttgtccctgctcagcccggaggctgtgcacggccctcgtcacaaggtgacccttgcagcacaggccgcgggtgccccaggctcggctcagttcttggaggtcaagggcatgggttggggtagtgggtggggaggtgaatgttttctagagattcaaactgctccagcaatttctgtatagttttcacctctgagaattacaatgtgagaaccgctaaaaaaaaaaaaaaaaaaaaaaaaaaaaaaaaaaaaaaaaaaaaaaaaaaaaaaaaaaaaaaaagggggggggggccaaaaaataccccccggggggccccctcccccccccgtttttttgacagggggcgccccccaataggggaggagccgctaatataaaacgagcgagacgagcgcggcgccgctatcaaccacaccggcgggggaggaggaaaccaccgagcctcccggggacgaaccacctgggaacagcaccccccaccctgcggggggggccaaccaatgtgggcccacccactcccggcaggaagtaatttaacgcgcccagcggcacaaccaacaccctgacggggtctagtgcgggcgcacacccgcggtactatgtgccgcggcaacaaaaattctggcccacgcgatttacgcttccaggcaatttaacagcagggcgagaagaacaaaccgccccacgacccaccaacgaccaccccccgcaaccgccccgacgcggcacccccaccacgcccaccatcaaccgccgccacgccacggaccacacgccacacacaccactgccaccaccacacgccgccctccacacccccggcgcccgaaccaccgccacgccgccaccgccacgccaccggcccc

SEQ ID NO: 33013 - DNA, 730 bp, Homo sapiens
gaaaataaaatagaaatttcatttacttgtaatcatgcttaaaatgggaggcaggtaggtgaagatataatttttagtaaaaactccaatttacattttaagtaattcagtgtattactaaaatactatatatataaacttaaaatacatgggttatcaatttaaaagacaaagtaagtaaaaatacttttagtaggcattcgtggattgtgaacatccaagttatattggtttgtatagaatggcattaagtaaaaattacagctgtataacagtagttttctaaattgagagagtccacattgtaattagagatcactgtgaccaaaatgcttctccttgatttataatgatgtactgtattttgtactgcttatatgaaatttcagcaagattgacgatattataaagatgcttataaagtgtaagtggagacgctaaattgtgagtacaaagtttctttttcacaacagtgataagaaaatatctttaaaaaatataagacaatataaacatgtcatcattagtttagctactattaaaatgtaacatctagaaagtactgatctccaccttcagacttctgtataagtatattttttcactgatctgttcattagagttcttccagccaagactctgggctcttaaaacatgtatctgaaaactaaaaacaagttaatttttttaaaagcttctctatttctagtgattcaataggtagaaaaat

SEQ ID NO: 33014 - DNA, 444 bp, Homo sapiens
actgaaagtaaaactctgtaaattcaatgcattcccaattaaaaatagccaaattgtctttaatgaaacttgtgaacagattctaattatataaaagacgaggcccaagaatagccagtagacttctgaggaagaatcaggctgaaatactttccaaaaagaaaccaaaactatgaagctatattaattaagactatgcagtactatcaatatacacaccaatataagctgaaccatatgaaattgccgacatgtgagtgtttttgctatataagaatggtgttttcatatggttcaacctaataaaattaagaactcagaaattgctccattacacaggaaaatctgatatacgcttgagctgacattgcagattaatagatgatttggacaattgattacccatatataaataaatgtattggatctttacttcaccacact

SEQ ID NO: 33015 - DNA, 358 bp, Homo sapiens
  misc_feature (265)..(265): n is a, c, g, or t
gaattacagtcacatgctataaaatgtttttccagagctctttctggcagttctctttccttaggttttcagcaagatttttgtttattctaccacaagattaaataatagtacagtatatatcaaaaccaacttgatctgtttttcatgggcttagaaatttataacttcattataatttggtatttgacagtgaacttaagtaatgagagaaatctttgtaatagaatatgttggtaaatatatgcctgtgaagaatttttangtgagtagagaatatttaataaaatgtttattttcccccttacacattagctgtttgaatatttttttaaatgatcagtcaacttccagaagt

SEQ ID NO: 33016 - DNA, 612 bp, Homo sapiens
ttaagcaagttcctttccctctctcctgctggtctttatttcttcactgttatagctagtatctcagggactattttaagcacaagtcgccacaaaaggtttaaacatctggaataatttctattagtcatctccacttggacaaaatgaagtaagagatcgtcccagcaggcaaatgaatggtggcaatttggcaattgagaagactcactgtacctcatctctcttttcttcccccagcacatcctccaagatcctagaatggctaaaatctgtaaagtgctgagagtcttcagagagttaaataagaatccagagaaacaaggttaacgttctgaggacctcgttatttgccaagaacaagcacaggggtgtcacctcctccgtgcagccttcagtaaccccaccacccaccaggaacagtaggagctcctgtactctcattagattcttgtacctacttgtcacattgtaacatgactgcctgtttgagtgcctgtctccctagatgatcttttggggcagggaccatgcctcattcatctttgtatctccagcacccagacggtaaccagcaccaaagaggtatttaataaacacagaatggacaga

SEQ ID NO: 33017 - DNA, 698 bp, Homo sapiens
aaagaggtggggtctgaccatctttcccaggctggagtacaatgactattcacaggtgcaatcatagctcgctgcagcctcaaactcctgggcttatgatcctcctgcctcagcatccccagcagctgagactacaggcacatgccaccatgcctggcaattcatttcctcacaacttccaaagtgttcttaaatgcaaatttcattcttctttaaaacccttaaatgattccctatgttttcagaataaaatccaaactcctgaggcagaaacttgtatgtcagggaatcttttgccccattctcttgcattctgatatttgcagcctcatcgacaaccaaacaactcaacattccttcaactcaccatagtttcccataacctctcactgtgctaaactctgtctgcaggttaacgttctgaggacctcgttatttgccaagaacaagcacaggggtgtcacctcctccgtgcagccttcagtaaccccaccacccaccaggaacagtaggagctcctgtactctcattagattcttgtacctacttgtcacattgtaacatgactgcctgtttgagtgcctgtctccctagatgatcttttggggcagggaccatgcctcattcatctttgtatctccagcacccagacggtaaccagcaccaaagaggtatttaataaacacagaatggacaga

SEQ ID NO: 33018 - DNA, 552 bp, Homo sapiens
atgggaacgggagcacccagcttcctcacccctgtaaggcacactctacacatcctcttgcaggtccccaggggtaacattcacaggtgctggggattagagtgacatctttgggaggtgttattcagcctaccccaagcagttgcaggcacaggcagcgtatataagggctctggggctgggtgtctacttggtggacggagctgattaggacaggaaggcaactgtggagagaacatcaaggaggtcaccagggccgagagtgtgtgggactctgtaggccaggatagcagctgtgggctttatttgaaatgaaatgggagccacgtgagggttttgagcagtggagagacatgacctgatgtccacttaaaatggcgattctcctgaggtcaggagttcgagaccagccttgccaacactgtgaaaacccatctatacgaaaaatacaaaaattagccaggcgtggtggcggagctgtaattccagcacttgggaggctgagacatgagaattgtttgaacccaggaggcagaggttgcagtgagccga

SEQ ID NO: 33019 - DNA, 513 bp, Homo sapiens
gtgacccccaacgctgctcacatggtgaggctggagtctatctcagctccaaaccctctcagctcctcaactgcctactgaccttgcccagtgggctacccaacaggagtctcaaactaatcacttccagagatgaccaccttcccccagcccaactcattttctgtcttcatctcatcacaatgaccatgggcggtctcaaccccacagccagaaacctggagtccctggattcagtcacctcgcctcccacactgaaatggcttctgtgtacttagctactgcatctagacattcctttttttttttctttgagacagagtcttgctctgtcacccaggctggcgtgatctcagctcactgcaacctctgcctcccacgttctagacgattctcttgtctcagcctccagagtagctgggattacaggcatgcaccaccacacccggctaattttgtatttttagtagaggcggggtttcagtgagctgaggaccatcgttgggggtcctc

SEQ ID NO: 33020 - DNA, 386 bp, Homo sapiens
tttttttttctttgagacagagtcttgctctgtcacccaggctggcgtgatctcagctcactgcaacctctgcctcccacgttctagacgattctcttgtctcagcctccagagtagctgggattacaggcatgcaccaccacacccggctaattttgtatttttagtagaggcggggtttcaccatgttggccaggctggtctcaaactcctgacctcaggtgattcccacgccttggcctcccaaagtgctgggattagaggcatgagccaccgcacccggtgacattccctttaaagctaaaataagactcaatataattaagaaacaataaaaccaccttctgagactctaaaaccacaaaaagtgtgaactttgcttttct

SEQ ID NO: 33021 - DNA, 478 bp, Homo sapiens
tgtatctcacatatacttgcatggcaaagattaccagttttatggtgttagcaagcaaatttatcatattctccacaaatctagtttgaataactcccaagcattaaacttatgcttagctgagttttggaagttgagtaaaatggatgacagagctgaaagttatgtaagaagcaaataaaagttcccccttacgcttgaatagccacctagacaatggctccaactgagtggccacaagaacagctgttgccttccagcaactaccccttaaattgtcattgctatttcctgagacagcattttgcaagtgtggtttcctgatcagcaacatttatcatcaccggggaacttgctggaactcagaaattctgagggtgaggcccagaaatgtgttttaacacactctctgggcagttctgacacatgctaacattgagaatttctggcctaaggccttattaattttccttttctt

SEQ ID NO: 33022 - DNA, 369 bp, Homo sapiens
cttgtttctttgccgagttaatgtgccgctcctgcctctttgctctcttcctgtttgatgccctcctccttgacacagcagttgagacagaccatggaagccacacagctttttgaatcccgctgttttctcctgcctgtgtgaccttgtgcaagttactttacctctccaggcctcagttgccttgcctgtaagatggggataatgatggtgccgccatcacagggcactgggaaagggttcgtgtgtctacactgcttaggactttagacactgtgggccacggtgactgcagtagggggtgatctgagggggaagtggtcaagggaaaggcccaggcctggaactggggccttttgttgggttccc

SEQ ID NO: 33023 - DNA, 507 bp, Homo sapiens
tcaggataccctactgggaagagccatgaactgaaagtcagtaccctggttcctatcccctggctttccccacaaactgagctatatgacctctgtatattcttcagaacttaagttgtcttatttggcaagtacaggcatcgcactagtctagatgatttcccatggcacccttcaagccctaaaattggcttgccaaatagtactgaaaagttctgatcacctcccaagacaggttagaaaatcgtctatagtggggaaaatgttctggtttcaaaataattgaggttaaaactttagccattttaattcccacttaggcagattctcttctgactgaatttaataacttcatagaattggacattatcaacaaaaatattacttccaccgggtgtgatggctcaggcctgtaatcccagctcttagtgaggcagaggcgggaggatagcttgagccaaggagctcgagacctgcctgggcaatatagcaagaccccattctcaa

SEQ ID NO: 33024 - DNA, 436 bp, Homo sapiens
tgagatggagtcttgctctgtcctccaggctggagtgcagtggcatgatcttggctcactgcaacctccacctcccgggttccagcgattctcccgcctcagcctcctgagtagctggaattacagatgcgcgccactacacctggctaatttttgtatttttagtagaaacggggtttcaccatattggccaagctggtctcaaactcctgacctagtgatccgcccgcctgggcctccctaagttctgggattacaggtgtgagccactgcaccaggcctgaccttgggcattctttttgtccttggttctcagtttcctcccctttaaaaggaggtgattgaacctccataagttcaatgaattagtccgaattctccaggaagcagactaagacaggattaaacattcaggggttttattagaggaagtgcc

SEQ ID NO: 33025 - DNA, 421 bp, Homo sapiens
aatcaaagacatagaaataaatgacattgcttagagaaagcatatagtgagagaaaagcctaggtttggggttgaacatccaaaggatgggttgagaatgaagaaccttcaaggagaccgaggaggggaaaccaataaattaagaaaaaaaatctggggagttagtctttggatgcctgcaaaaaggaatggtttggaaggtgagagaagtcaacaatgtaaatttgtttaaagaatatgcaggatatggccgggtgcagtggctcacacctgtaatcccagcactttgggaggccaaggcggacggatcacctgaggtcgggagttcaagaccagcctgaccaacatggagaaaccccgtctctactaaaaatacaaaattagccgggcatggtggcacatgcctgtaattccagctact

SEQ ID NO: 33026 - DNA, 283 bp, Homo sapiens
gctaccaaaggaaaagtactgcatgattctatgtatatgcagtatctaaagtagtcagactcatagaaagttagaatggtgcttaccagggactgggggaaagggaaatgtggattagtgtttaatgtgtacagagtatcagatttgcaagatgacaaagatctggagatctgtttctcaacaatgtaaatatacttaacactactaagctgtacacttaaaatggttaagatggtaagttttgtgataagtgttttaaccataataaaaatatttttaaaac

SEQ ID NO: 33027 - DNA, 377 bp, Homo sapiens
ttttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttattt

SEQ ID NO: 33028 - DNA, 509 bp, Homo sapiens
agcactccagcctgggtaacagagcaagactccatcccccatgccccctccaaaaaaaagacacctacactcatatgttcattgcagcactattcaaaatagcaaagtcatgaactcaacctagatgcctatgaatggttgactggataaagaaatgtagtacatatacactatggaatagccataaaaatcatgtcctttgcagcaacatggatgcagccagaggccattatactaagttaatcaacacagaaacagaaaataaaatactgtccagttataagtgggagctaaacaatgggtacacactgacatagagatggaaacagtagacactggggactccgaaagaggcagggacggtggagagaaagggttgcaaaactacctgttggttactatgtttactgtttgggtgatgggtacaacagaagcccaatcccaaacattatggaatatatccatgtaacaaatgtgcttatgtatccccgagtctaaaatcaatcaaa

SEQ ID NO: 33029 - DNA, 317 bp, Homo sapiens
atgtgagttgctcaaagtcacactatagctgtcaggactaaacatgactctctctatacacaatatgtctccatatctatgtctacctatatccagggctttgtatctaccctgatacccactatctagtagatatctatattcattgcaccagtattttccagatttcagtacttcgtaattctcaatctgtaccatatgtactcaccatcttcctattatttgtttccttcaagtcaactcagattttccctcgtttatttaaaaacaacatttgtaacaccagtgtaaataaaaaaccagtttacttaccaaaa

SEQ ID NO: 33030 - DNA, 342 bp, Homo sapiens
gattcctaagatgtcccttcaaacttttcaagcatccatttcctcatctgtagcttattaatattacatctatcatctgggaatgatactagtacctctctcgtagggtggttgtgaggattcactttgctaaatgtccataaagcacttcttagtaccgtttctggtatatagtaagcacctaagaaatgggaactgctatagaatgactgcctttaaggtggaatcttcctctttcagagaacaatacatcagggtccagctgctttcgatttaaattttcactgtattttatgggaatatgccttgaatcatcacaatttccaataaaagactttattg

SEQ ID NO: 33031 - DNA, 1551 bp, Homo sapiens
gtttggagagcaaagaagtgagcccaggggatatctaagtgcttatgtgaccccgcacctctcgctccttttgatgagccatgttcgcattttggaaggagaaagggggtgcagaagaggcgtctgatgcaggccctgctgacaggcagtcaagggcatccctcaagtcgatgtagtcaagggccagagctgcaggatcccgggctcggataatgcatctcagatcaacgaaggataccaaaggcaggtgctttttactcatctgctcccactgactccttcgtccccctccttcctgcttcggacctacttctgatacagtgagggagaaagacaagagtggcaagacagtgtattttctctggaacatagtccatcctcccctcctcacggtctctgcctgagctcagagccccatctgctttcccccagaccctcttgactcggggttgtctgagagcctgcaacattggcatcacctggggcttgttggacatgctgactcttggattccacccaggcctgctgtagcatatcttctactgtaacggaatcgccaggtgatgaatatacacatccaagtgttggtgtgctgccctagaaggtcaggattaacagttggtattttcccgttgtcccaagcacctattctcctttaatccattctgaacatcaactgggttctagtttgaaaacaaaattcagctgtgtctgttctttgcctaaaatccttgcttggcttcacattgcttttttcctatatatcaacaataaacaagtggaatttgaaatttaaagcacaaaaccatttataatagcatgcaagaaattaaatacttaggtaaatctaacaaaatatgcatgagatttatatgaggaaaacgacaaaactgattaaagaagtcaaagaagtcaatggagaaatattccaagttcatggataggaagacttaatatagtcaagatgccggttcttccccaaattcataaatggattcaatgcactcctcataaaaatcccagtgagttgttttttggatacggaaaaactgattctaaagtttatatggaaagggagactgccctggagtagccaacacagtactgaagggcaagagcaaaggaggagaaatgacgctgcctgccttaaagacttaccataaagctacaggcatcaagataggttggcaaaagaacagacagatggatcagttgacagagcagacagcccagaagcagatccacataaaaatatggcctatgaatcttgacaaagaagtaaaggtaatacggtggaggcaagattatcttttcaacaaatggtactgaaacagctggctctccacatgcacacacaaaaaattgaatctaaacatagaccttacacttttcacaaaaattaattcaaaatagatcacaggcttaaatatgagacataaaacttaaaactcctagaagataacataggagaaaatctagatgacctcaggtttgatggtgatgttttagatataatacaaaaggcatggggcatgaaaaaaataattgaga

SEQ ID NO: 33032 - DNA, 270 bp, Homo sapiens
aaaatccagcaggcacatctcactggttaggggaaactggcggcttttccgtggtcccgggctcggataatgcatctcagatcaacgaaggataccaaaggcaggtgctttttactcatctgctcccactgactccttcgtccccctccttcctgcttcggacctacttctgatacagtgagggagaaagacaagagtggcaagacagtgtattttctctggaacatagtccatcctcccctcctcacggtctctgcctgagctcagagc

SEQ ID NO: 33033 - DNA, 565 bp, Homo sapiens
aaaaaaaaatccccagctttgaagctcagggcaaagcagccctgcttgtttcagtcacctagatatcgatatggaacctccagaacagttttcccatgccatttttcaacagcttgggcaactgcctgtcactctctcctgtactacctctgtcacacgttctagtgatttccatatccacgtagatgatccttccagtacccgggcctcccagttcctggacatcctttcctccctgatcttgtgctctgcctacccaagccactgctctgttggccattccctaaactttgtcattaacaaagccccttctgtgacttcaatttcaagcaactcatgctccaccagctttctaatttcctccagttccccaattccaataacttgttgacactacactcaggacttgtagtccctttttcctcctgccccctcactggcttccccacatcctgtctttcctcctttcctagctcatatgctgtggtccagaatcaagatgagttctttacatatttgactccctcacctttgcaggcacctggcaacaccaaaccccatgatg

SEQ ID NO: 33034 - DNA, 489 bp, Homo sapiens
catctggagcatgggctcagtccatgtcctcaaccactacacaagggacaggaaggcagaaacttaagcttggattctaaggcctgaaaggccaagaaaaatgtttcagtctccctctctcaccattcccatctgcaagtgggggctctgctgttgatcagctttggctaatgatgttcaatttctaatcagcctttggactttgacaggggaggcacagaccatcaaggagaggggacaaactttgaaataggcaaattctcgttcaatcctaactctgccacttagaagctgcattgcctttaggaggtggtttagcaactcactgtcctcacctgtcaaatgggctggtatcactgtctcgtgcattccctgcgagaattaaattaggtttgtatgccaatcgccagtcccagtgcttggcacataagggcatttcataagcgtcagttgcccttccaaggctctgaggtcctcccatggttccat

SEQ ID NO: 33035 - DNA, 107 bp, Homo sapiens
tctccttccataacatctgcccttaatgggcatggatttccccttggagtaagaagtctgaggagcgtgtgatggagaaagattggtgttgctttttattgtaccat

SEQ ID NO: 33036 - DNA, 369 bp, Homo sapiens
taaaataagtctagccaacttgcaaagccacccaccagcttcaacttgattgaaatcagctgaatcggaatgacagcatcacaggcgttcacagagatcagggggaaggatggggagcagagccaggaggggccacctcagcgaggcctgcaacaggaggtgtttattctttaggcccctaagaatgactggagtcattcctgaccttgtggctcttgatagagtagtgaatggaaaggcactattaatctgcaaatagaaggggacttgggagctcaaaacctgtctgtaaataagctttgagggggcgaaggttggaaagtcagtgcattacaagtttaaagcatcaggtgcacttggatttggccc

SEQ ID NO: 33037 - DNA, 307 bp, Homo sapiens
tcttttttttgtagagacagggtcttgctatgttgtctaggctggttactcctgggctccagtgatccttccaccttggcctcccaaaacacagggattacaaacatgtgagccactgtacccagccaaaactttaagttaaaattatttcaacctaaaagttaaaaagggaaaacccaggctatgtgacataatacaaaggagacagctttggagatgaaatccttgctgccctatttactactattagctagtgacctgaggtggccatagcgcctccctgagtggcccttcctcctgggtccaa

SEQ ID NO: 33038 - DNA, 1086 bp, Homo sapiens
cgccccgtctttgccctcgcgacgccgccacctccggaacaagccatggtggcggcgacggtggcagcggcgtggctgctcctgtgggctgcggcctgcgcgcagcaggagcaggacttctacgacttcaaggcggtcaacatccggggcaaactggtgtcgctggagaagtaccgcggatcggtgtccctggtggtgaatgtggccagcgagtgcggcttcacagaccagcactaccgagccctgcagcagctgcagcgagacctgggcccccaccacttcaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataaccaccgcgtctcctcctccaccacctcatcccgcccacctgtgtggggctgaccaatgcaaactcaaatggtgcttcaaagggagagacccactgactctccttcctttactcttatgccattggtcccatcattcttgtgggggaaaaattctagtattttgattatttgaatcttacagcaacaaataggaactcctggccaatgagagctcttgaccagtgaatcaccagccgatacgaacgtcttgccaacaaaaatgtgtggcaaatagaagtatatcaagcaataatctcccacccaaggcttctgtaaactgggaccaatgattacctcatagggctgttgtgaggattaggatgaaatacctgtgaaagtgcctaggcagtgccagccaaataggaggcattcaatgaacattttttgcatataaaacaaaaaataacttgttatcaataaaaacttgcatccaacatg

SEQ ID NO: 33039 - DNA, 1228 bp, Homo sapiens
cgccccgtctttgccctcgcgacgccgccacctccggaacaagccatggtggcggcgacggtggcagcggcgtggctgctcctgtgggctgcggcctgcgcgcagcaggagcaggacttctacgacttcaaggcggtcaacatccggggcaaactggtgtcgctggagaagtaccgcggatcggtgtccctggtggtgaatgtggccagcgagtgcggcttcacagaccagcactaccgagccctgcagcagctgcagcgagacctgggcccccaccacttcaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataaccaccgcgtctcctcctccaccacctcatcccgcccacctgtgtggggctgaccaatgcaaactcaaatggtgcttcaaagggagagacccactgactctccttcctttactcttatgccattggtcccatcattcttgtgggggaaaaattctagtattttgattatttgaatcttacagcaacaaataggaactcctggccaatgagagctcttgaccagtgaatcaccagccgatacgaacgtcttgccaacaaaaatgtgtggcaaatagaagtatatcaagcaataatctcccacccaaggcttctgtaaactgggaccaatgattacctcatagggctgttgtgaggattaggatgaaatacctgtgaaagtgcctaggcagtgccagccaaataggaggcattcaatgaacattttttgcatataaaacaaaaaataacttgttatcaataaaaacttgcatccaacatgaatttccagccgatgataatccaggccaaaggtttagttgttgttatttcctctgtattattttcttcattacaaaagaaatgcaagttcattgtaacaatccaaacaatacctcacgatataaaataaaaatgaaagtatc

SEQ ID NO: 33040 - DNA, 1312 bp, Homo sapiens
cgccccgtctttgccctcgcgacgccgccacctccggaacaagccatggtggcggcgacggtggcagcggcgtggctgctcctgtgggctgcggcctgcgcgcagcaggagcaggacttctacgacttcaaggcggtcaacatccggggcaaactggtgtcgctggagaagtaccgcggatcggtgtccctggtggtgaatgtggccagcgagtgcggcttcacagaccagcactaccgagccctgcagcagctgcagcgagacctgggcccccaccacttcaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataaccaccgcgtctcctcctccaccacctcatcccgcccacctgtgtggggctgaccaatgcaaactcaaatggtgcttcaaagggagagacccactgactctccttcctttactcttatgccattggtcccatcattcttgtgggggaaaaattctagtattttgattatttgaatcttacagcaacaaataggaactcctggccaatgagagctcttgaccagtgaatcaccagccgatacgaacgtcttgccaacaaaaatgtgtggcaaatagaagtatatcaagcaataatctcccacccaaggcttctgtaaactgggaccaatgattacctcatagggctgttgtgaggattaggatgaaatacctgtgaaagtgcctaggcagtgccagccaaataggaggcattcaatgaacattttttgcatataaaacaaaaaataacttgttatcaataaaaacttgcatccaacatgaatttccagccgatgataatccaggccaaaggtttagttgttgttatttcctctgtattattttcttcattacaaaagaaatgcaagttcattgtaacaatccaaacaatacctcacgatataaaataaaaatgaaagtatctcctcattttccatagtctccctccctagaggtaaacagtgttagcagtttggtacaaaggctgccaggcctttggttaagcca

SEQ ID NO: 33041 - DNA, 424 bp, Homo sapiens
agtatgtgtgccccagtctgtggatgtgctgtgtgtgtgggcatgtgtggtgtttgctaacatgtttgtatcgtggtgcatgtgcatacctatttatgtatgttgtatacttatgttcacagatgttcatgtatgtgtgcacacatctgtaagctcctgaatgtttgatttcatatgtgcctgtctgtgtgcatgtgtttgtgtatgtgtgagagcactggacacacatttacatatgtgtacacagtgttcttgtatgtgtgaggcagtattaactgttgagggagtcacatatgtggatgtgtcagggcatgtacaggttcatgcctcttcactggcttgtctgggctttgttttgttttgtttctgtcatacaggtgtccctggtggtgaatgtggccagcgagtgcggcttcacagacca

SEQ ID NO: 33042 - DNA, 459 bp, Homo sapiens
ccttatattttgtaagtagcttctttttataagattgagaatcgtcttatgatcatgcttctttgattaaagcgtgcagtgagccaagtatccctctgtaactgttattagccatcccttaaagtacattttgtacctaatttttgcacaccaaggctaacagctctcccataatgcagagtaatttctgatacccccaaaacttggaaaaaaaaaaaaacgtcaggtaacataatgtaaagctgaacagagccttagattttgagagcgatctatccactttcaactcctggggttccatgaggaaaacaggttttttttttttccaaagtggaagctgttagaaattatcttaagttctctcatgtgggcatcaggagggcaaagtagagaaataattcagttgactgagaagaaaaacaaaaactttttcacaaaaacaaccaatatccaagaaga

SEQ ID NO: 33043 - DNA, 546 bp, Homo sapiens
agtcccagctgctcgggaggctgaggtgagagaatcacctgagcctgggagaggctgtagtcagctgtgattgcgccatgcactccagcctgggtgacacagtgagaccctgtctcaaaaaataaataaaaaataaaaaaaggagccctcaatttatcctctgcctctgacaaatatattccattttgttacattgcaaaaatttcagcacattgctttgcttacccatctttgctctggaacgacttttaattcttcttttggcaatcttggttgttttgagatgtgtgaaattagaatcatatgcaggtgtttgagttcttttgattttgctttttaaaagagttttttttttgttttgttttgttttgtttttagaatggggcaatgtaaagccagaatatcaacgtccttttgtcaagattttcaaacctatttggctgatagtacacttacaagaataggtaaaaaagatcccaaagattttacttcacttacttgaactactagccctactattaagagccacagcaagcttacatgttc

SEQ ID NO: 33044 - DNA, 318 bp, Homo sapiens
gaattctaattcataaacaggattatccactcaaaattcaagttgattttcttctagaaaacactgattagtggtttaatatttaaaaaatatgtaacacttcataaatttgtgtttcatccttgcacaagggccatgctaatcttctctatatcgttccaattttagtacatgtgctgccgaagtgagcactgattagtgttttctagacagagatcaggaataggcgtgtgcatgtgtaatatgtagagattgggataaaaccagtgatcatatttgagaatcatagtaacattaattgatcacttataatgtgtt

SEQ ID NO: 33045 - DNA, 471 bp, Homo sapiens
gaatttctttttcgtactgctagaaaacacttactgtttctctcacttaatgtcttctgccgaggagtcactgtgtctgtttacttgtatatatcttactgctcttgtactagatcacatgctttttcagcgcttacactgtgtcttcttgaacttattccagttgaatttttcaatcttaagggtttgctttttaaaatccacactgtatcatttaggttctaagtgatgaacatgactgggataggattttttggagtaaagtttctaaatggtcataacaaggaccagttgtaaaggcccagccagagcaggctttgtaaaaactcacctacttagctggaatttaggagagtaatacaattgtcctaaacttactctggtaggaatttaaaactataattttgatgtctttgtagtaatactaaataaaagtattagtactggaatgaattgtgtttttcttcacag

SEQ ID NO: 33046 - DNA, 1081 bp, Homo sapiens
aagaggcccagagcagagggcaagtgagcacggcagtaagaagttgaaaaccattaattgtccgtccagaggaggcggatgcccacaacattctgggcaaaggagatggtgtgtgcaaaagcacggaggtgtgagaatatagcatagtagacattcatcattcctttctcatgcactggagtgtctgtgcagccagggtcctcccattcattcattgattcattcacctgtttattcaccaaatagttaccaagtgctgggcaccctctggaatggggaaaaacaaacagcattgttcctgcctcagagagtgcacagcctgttaggaaattgcaggacagagcagtgagttccttggtgaggggcacacaggcactgtgggaacctggaacagaggacctgatggggacacacagacacctcaggagcccatggtaaccccaaggaggggtctgggcaggaccagggcttatcagcaacttttttttcatttgtcagcctttgatatccgatcttcagcggctctcataggtgacaggaccgttagcagtccaggtctgtgtccttcattgcacagatggtgaatctgcagccctaggcctggaactcaagtctccaggactcctgtttccagagtataattgtattgacaaagctcatccatagtcaaacccaaccctggacccacacggggctcagctctctctgcacagcaccttctgtagcccaaaagtggaattgcagacccaggacactgcttctctggcagagccagccctggctgggctccctcacatcggagcctgtgccctcagtctagcaggagccactgggggccttgggcatttcattggccgtcagtgtcccaccacagaatgtcaacaggattcctagcctgcctatcacactgggtggctgtggagatggagagtgttggcccccatgacccgcgttctccgggaggcctttctgctgaggggaggaaagacgggcccatggctggctttccctcctcctcagtgcctctgaagccatgcgtcacttacaaattctcttcatttctaaataaaatgatttgtta

SEQ ID NO: 33047 - DNA, 1035 bp, Homo sapiens
taaaaaaaaaaaagccagtaacttataaaaatagccataaacgacgtagttttttgttgttgttgttgttttgagacagcgtctccctctgtcccccaggcgggagtacagtggcaggcactcagctcactgtaacctccgcctcctgggttcaagtgattctcttgccccagcctccagagtagccaccacgcccggtccaacttagttttttaatactttttaaaattttaagacagggtctctgccaccgaggctgaaatgcagtggcgcaatcatagctcactgcaaccttgacttcctggggtcctgggcaggtgaccccctgtctcagcctgccgagtagctgtgagtaaaggcctgtgcctctccactgtgctaattttctactgtttgttgctttgtttttaatagagatgtagtctggttttgttgcccaggctggtctccagcttctagcctcaagcagtcttcccatctgctcctaccaaagtgctcggattataggcatgaatcaccttgcatgggagataaggacccccacatcaagccctcaggttatttttgaaacacaaatacataaggcccacaagcaggcccattggctgcagacagtggggtcacctgaagaacttttctttgatctgagtaccaacttctcacctaggtcactgggatcctggactacggcactgctccaggcaggcctggttatcctgcttgaggcagcaatcctcttgagcctagtgaaatgcaactggctgtacctcaatgatgttgccctgagattctgccagtcgaggtattacttcaatctcctgagaccagcctctacctccagatccagggaggtcagtgcacatataaatggactagctttattaaaggggatatctgggccaggcgtggtggctcacgcctgtaatcccaatactttgggaggccgaggagggcagatcacctgaggtcgggaattagagaccagcctggttaacatggtgaaacgaagtctctactaaaaatacaaaaaaaaaa

SEQ ID NO: 33048 - DNA, 598 bp, Homo sapiens
acattaactcagaagggaattcagaagcctgcaaggacaggatgctgatatccgtgttgagggtggtcagcggcgtcctggacgcctggttctgccctttctggtggccaccagaaagagagagaagagagagagtaaagagaaagagaaaagaaagagaagttgaaaaagagaaagaaaaccaagaaagaaagagaaaaaaaccgaaaataaatggacaagaaagaaaagtcactgggatcctggactacggcactgctccaggcaggcctggttatcctgcttgaggcagcaatcctcttgagcctagtgaaatgcaactggctgtacctcaatgatgttgccctgagattctgccagtcgaggtattacttcaatctcctgagaccagcctctacctccagatccagggaggtcagtgcacatataaatggactagctttattaaaggggatatctgggccaggcgtggtggctcacgcctgtaatcccaatactttgggaggccgaggagggcagatcacctgaggtcgggaattagagaccagcctggttaacatggtgaaacgaagtctctactaaaaatacaaaaaaaaaa

SEQ ID NO: 33049 - DNA, 785 bp, Homo sapiens
tctgtcagctaacatcctactacaatgtgaaaaatcaatgctttctacctaagacgaggtagagggcaaggatgttggctctcatcatttttatttaacttaaattgtataggagtgcctagtcagtgcaacaaagcaagggaaaaataaggcatacatgctagaaagaaataagtaaaattgtccttatctacaagtgacattgtatagaaaaccctaagaaacccacaataaaagctattagaggtacaaggttgcaggataaaatatacaaaaatcaattcaaggttgcaggataaaatatacaaaaatcaattctgtctcacatactagcaactaacatttagaaagttaagttataagacactttgtttacaatagcataaaatacttagcaaaagacatgtatgacctgtaggctgaaaacaataaaacatgacaggaagatctgcataaatgaacagctataccgtgttcatggattcaaagtctcaatattgttaagctggcaatcctttttgaattattcaataaattcaatgcaattcccacgaaaatcgtaactttttttttgaaaaaaatttgcaagagtattttaaattttatatgggaagtcaaaggacctagtatagccacatcgttttgaaagaggagaacaatattggaacacttcagctacctgatttcaagaacaatatgtggctctgaaggaatgaaccaattttattctttgatctataaattggcatttaaataatttccaaatgaggagagatgggtagctc

SEQ ID NO: 33050 - DNA, 488 bp, Homo sapiens
gtctagaggtccctggtatgctgtctcacatactagcaactaacatttagaaagttaagttataagacactttgtttacaatagcataaaatacttagcaaaagacatgtatgacctgtaggctgaaaacaataaaacatgacaggaagatctgcataaatgaacagctataccgtgttcatggattcaaagtctcaatattgttaagctggcaatcctttttgaattattcaataaattcaatgcaattcccacgaaaatcgtaactttttttttgaaaaaaatttgcaagagtattttaaattttatatgggaagtcaaaggacctagtatagccacatcgttttgaaagaggagaacaatattggaacacttcagctacctgatttcaagaacaatatgtggctctgaaggaatgaaccaattttattctttgatctataaattggcatttaaataatttccaaatgaggagagatgggtagctc

SEQ ID NO: 33051 - DNA, 3714 bp, Homo sapiens
cccggcggggcgggggtcagctctggtcccgttggtcctgggcgcggcgccatggcctccgaggcggtgaaggttgtcgtgcgctgccgtcccatgaaccagcgggagcgagagctgcgctgccagcccgtggtgactgtggactgcgcgcgcgcccagtgctgcatccagaacccgggcgccgccgacgagccgcccaagcagttcaccttcgacggcgcctaccacgtggaccacgtcaccgagcagatctacaacgagatcgcctatccgctggtggagggcgtcactgagggctacaatggcaccatctttgcctacggccagacaggcagcgggaagtccttcaccatgcagggcctgccggatccgccctcccagagaggcatcatccccagggccttcgagcacgtgttcgagagcgtccagtgtgcagagaacactaagttcctggtccgggcctcctacctggagatctacaatgaagatgtccgggacctccttggggctgacaccaagcagaagctggagctgaaggagcacccagagaagggcgtgtacgtgaaggggctgtccatgcacacggtgcacagcgtggcccagtgtgagcacatcatggagactggctggaagaaccgttcggtcggctacacgctgatgaacaaggattcctcacgctcgcactccatcttcaccatcagcatcgagatgtctgccgtggatgagcggggcaaggaccacctccgggcgggcaagctgaacctggtggacctggcgggcagcgagcggcagtccaagaccggggccacgggcgagcggctcaaggaggccaccaagatcaacctgtcgctctcggcactgggcaatgtcatctcggcgctggtggacgggcgctgtaagcacgtcccctaccgtgactcgaagctgacgcggctgctgcaggactcactgggcggcaacaccaagacgctcatggtggcctgcctgtcgcctgcggacaacaactacgatgagacactcagcacgctgcgctacgccaaccgggccaagaacatcaggaacaagccgcgcatcaatgaggaccccaaggatgcgctgcttcgcgagtaccaggaggagatcaagaagctcaaggccatcctgacacagcagatgagccccagcagcctgtcagccctgctgtccaggcaggtgcccccagaccctgtgcaggtggaggagaagctgttgccccaacctgtgatccagcatgacatggaggccgagaagcagctgatccgggaggagtatgaagagcgcctggcccggctgaaagccgactataaggccgagcaggagtctcgggccaggctggaggaagacatcactgccatgcgcaactcatatgacgtcaggctgtccacgctggaggagaacctgcggaaggagacagaggctgtcctgcaggtgggagtcctctacaaggctgaggtcatgtccagggctgagtttgccagcagcgctgagtacccgcctgcttttcagtatgagacagtggtgaaacccaaggtcttctccacgactgacactctgcccagtgacgatgtctccaagactcaggtttcctccaggtttgcggagctgcccaaggtggaaccctccaaatctgagatttctctgggctccagtgagtcatcctcgctcgaagaaacctctgtgtccgaggctttccctgggcctgaggagccctccaacgtggaggtctccatgcccactgaggagtccaggagcagatacttcctggatgagtgcctcgggcaggaggccgctgggcacctgctgggggaacagaactacctcccgcaagaggagccgcaggaggtgcccctgcaggggttactaggcctgcaggacccgtttgccgaggtggaagccaagctggccagactctcctccaccgtggccaggacagatgcaccccaggcagacgtccccaaggtccctgtgcaggtccctgcgccgacagacctgctggagcccagtgatgccaggcccgaagccgaggcggctgatgacttcccgcccaggcctgaggtagatctggcctcggaagtggccttagaggtggtgcggacagcagagcctggcgtgtggttggaggctcaggccccggtggccctggtggctcagcctgagcccctgccggccacagctggtgtgaagagggagagcgtgggcatggaggtggcagtgctgactgatgacccgctgcccgttgtggaccagcagcaggtgctggcccgtctgcagctgttggagcagcaggttgtgggtggagagcaggccaagaacaaggacctgaaggagaagcacaagcggcgcaagcgctacgcagacgagcgcaggaagcagctggtggctgccctgcagaactcggatgaggacagcggggactgggtgctgcttaacgtctacgactccatccaggaggaagtgcgggccaagagcaagctgctggagaagatgcagaggaagcttcgggcagcagaggtggagatcaaagatctgcagtccgagtttcagctggagaagatcgattacttggccaccatccgccggcaggagcgtgactccatgctcttgcagcagctcctggagcaggtgcagcccctgattcgcagggactgtaactacagcaacctggagaagattctgcgtgagtcctgctgggacgaagataacggcttctggaagatcccacatcccgtcatcacaaaaaccagcctcccagtagcagtttcaactgggccacagaacaaaccagcccgcaaaacctctgcagcagacaatggcgagccgaacatggaggaggaccgctacaggctcatgctcagtcggagcaacagtgaaaacattgccagcaactacttccgatctaagcgggccagccagatcctcagcacagacgccaggaagagcctcacacatcacaactcgccaccaggcctcagctgcccactcagcaacaactctgccatcccacccacccaggcccctgaaatgccccagccccggcccttccgcctcgagtccctcgacatccctttcaccaaggccaagcgtaagaaaagcaaaagcaactttggcagtgagcctctgtgagcacagctgcttgccattgcctgccttataggcatgtagagactgccaggccctcccagggcagccccaaccaggtctcctcccacctgccacacagcgctccggggcctgagggctccctcagccctgggaagacacattcccttccctgttccccagagagcccacctccgccctgggcaggagcccctcggaggctgtatagtcctccttagagaggcctgctccagctgttcataccacatcagtgtttccgtctgctcacctgccacagagcccacacccatgcccaccagtgttggtctttgcctcaaagcctgagacctgcttcacggccttcaccagccctgatggagagggcagcagctgccacgtggaggaagctcaatatcagctgggaaggaactgtgcctctgtctgactggccccacttcctaagcactgccctgccccatggggtggcacaggggtcccacagcaggtcttcctgcactgcccacccctggctggtctgtggcccaaggaaggccactccacattaagctgcccaataaactgcttttaagataaact

SEQ ID NO: 33052 - DNA, 1815 bp, Homo sapiens
gtaagaactcaacagggcgtgtttttgtgtcactggtgtccctgagctggaggtgatctgtcggggctgcagcaggcggaatggccccgtctgggattgagccacctgggagctgtcggcgggggttggggcggccttcccacctccacctgggtttctcttcacactcaggaggtagatctggcctcggaagtggccttagaggtggtgcggacagcagagcctggcgtgtggttggaggctcaggccccggtggccctggtggctcagcctgagcccctgccggccacagctggtgtgaagagggagagcgtgggcatggaggtggcagtgctgactgatgacccgctgcccgttgtggaccagcagcaggtgctggcccgtctgcagctgttggagcagcaggttgtgggtggagagcaggccaagaacaaggacctgaaggagaagcacaagcggcgcaagcgctacgcagacgagcgcaggaagcagctggtggctgccctgcagaactcggatgaggacagcggggactgggtgctgcttaacgtctacgactccatccaggaggaagtgcgggccaagagcaagctgctggagaagatgcagaggaagcttcgggcagcagaggtggagatcaaagatctgcagtccgagtttcagctggagaagatcgattacttggccaccatccgccggcaggagcgtgactccatgctcttgcagcagctcctggagcaggtgcagcccctgattcgcagggactgtaactacagcaacctggagaagattctgcgtgagtcctgctgggacgaagataacggcttctggaagatcccacatcccgtcatcacaaaaaccagcctcccagtagcagtttcaactgggccacagaacaaaccagcccgcaaaacctctgcagcagacaatggcgagccgaacatggaggaggaccgctacaggctcatgctcagtcggagcaacagtgaaaacattgccagcaactacttccgatctaagcgggccagccagatcctcagcacagacgccaggaagagcctcacacatcacaactcgccaccaggcctcagctgcccactcagcaacaactctgccatcccacccacccaggcccctgaaatgccccagccccggcccttccgcctcgagtccctcgacatccctttcaccaaggccaagcgtaagaaaagcaaaagcaactttggcagtgagcctctgtgagcacagctgcttgccattgcctgccttataggcatgtagagactgccaggccctcccagggcagccccaaccaggtctcctcccacctgccacacagcgctccggggcctgagggctccctcagccctgggaagacacattcccttccctgttccccagagagcccacctccgccctgggcaggagcccctcggaggctgtatagtcctccttagagaggcctgctccagctgttcataccacatcagtgtttccgtctgctcacctgccacagagcccacacccatgcccaccagtgttggtctttgcctcaaagcctgagacctgcttcacggccttcaccagccctgatggagagggcagcagctgccacgtggaggaagctcaatatcagctgggaaggaactgtgcctctgtctgactggccccacttcctaagcactgccctgccccatggggtggcacaggggtcccacagcaggtcttcctgcactgcccacccctggctggtctgtggcccaaggaaggccactccacattaagctgcccaataaactgcttttaagataaact

SEQ ID NO: 33053 - DNA, 2704 bp, Homo sapiens
cccggcggggcgggggtcagctctggtcccgttggtcctgggcgcggcgccatggcctccgaggcggtgaaggttgtcgtgcgctgccgtcccatgaaccagcgggagcgagagctgcgctgccagcccgtggtgactgtggactgcgcgcgcgcccagtgctgcatccagaacccgggcgccgccgacgagccgcccaagcagttcaccttcgacggcgcctaccacgtggaccacgtcaccgagcagatctacaacgagatcgcctatccgctggtggagggcgtcactgagggctacaatggcaccatctttgcctacggccagacaggcagcgggaagtccttcaccatgcagggcctgccggatccgccctcccagagaggcatcatccccagggccttcgagcacgtgttcgagagcgtccagtgtgcagagaacactaagttcctggtccgggcctcctacctggagatctacaatgaagatgtccgggacctccttggggctgacaccaagcagaagctggagctgaaggagcacccagagaagggcgtgtacgtgaaggggctgtccatgcacacggtgcacagcgtggcccagtgtgagcacatcatggagactggctggaagaaccgttcggtcggctacacgctgatgaacaaggattcctcacgctcgcactccatcttcaccatcagcatcgagatgtctgccgtggatgagcggggcaaggaccacctccgggcgggcaagctgaacctggtggacctggcgggcagcgagcggcagtccaagaccggggccacgggcgagcggctcaaggaggccaccaagatcaacctgtcgctctcggcactgggcaatgtcatctcggcgctggtggacgggcgctgtaagcacgtcccctaccgtgactcgaagctgacgcggctgctgcaggactcactgggcggcaacaccaagacgctcatggtggcctgcctgtcgcctgcggacaacaactacgatgagacactcagcacgctgcgctacgccaaccgggccaagaacatcaggaacaagccgcgcatcaatgaggaccccaaggatgcgctgcttcgcgagtaccaggaggagatcaagaagctcaaggccatcctgacacagcagatgagccccagcagcctgtcagccctgctgtccaggcaggtgcccccagaccctgtgcaggtggaggagaagctgttgccccaacctgtgatccagcatgacatggaggccgagaagcagctgatccgggaggagtatgaagagcgcctggcccggctgaaagccgactataaggccgagcaggagtctcgggccaggctggaggaagacatcactgccatgcgcaactcatatgacgtcaggctgtccacgctggaggagaacctgcggaaggagacaggtccctgcgccgacagacctgctggagcccagtgatgccaggcccgaagccgaggcggctgatgacttcccgcccaggcctgaggtagatctggcctcggaagtggccttagaggtggtgcggacagcagagcctggcgtgtggttggaggctcaggccccggtggccctggtggctcagcctgagcccctgccggccacagctggtgtgaagagggagagcgtgggcatggaggtggcagtgctgactgatgacccgctgcccgttgtggaccagcagcaggtgctggcccgtctgcagctgttggagcagcaggttgtgggtggagagcaggccaagaacaaggacctgaaggagaagcacaagcggcgcaagcgctacgcagacgagcgcaggaagcagctggtggctgccctgcagaactcggatgaggacagcggggactgggtgctgcttaacgtctacgactccatccaggaggaagtgcgggccaagagcaagctgctggagaagatgcagaggaagcttcgggcagcagaggtggagatcaaagatctgcagtccgagtttcagctggagaagatcgattacttggccaccatccgccggcaggagcgtgactccatgctcttgcagcagctcctggagcaggtgcagcccctgattcgcagggactgtaactacagcaacctggagaagattctgcgtgagtcctgctgggacgaagataacggcttctggaagatcccacatcccgtcatcacaaaaaccagcctcccagtagcagtttcaactgggccacagaacaaaccagcccgcaaaacctctgcagcagacaatggcgagccgaacatggaggaggaccgctacaggctcatgctcagtcggagcaacagtgaaaacattgccagcaactacttccgatctaagcgggccagccagatcctcagcacagacgccaggaagagcctcaagcccacacccatgcccaccagtgttggtctttgcctcaaagcctgagacctgcttcacggccttcaccagccctgatggagagggcagcagctgccacgtggaggaagctcaatatcagctgggaaggaactgtgcctctgtctgactggccccacttcctaagcactgccctgccccatggggtggcacaggggtcccacagcaggtcttcctgcactgcccacccctggctggtctgtggcccaaggaaggccactccacattaagctgcccaataaactgcttttaagataaact

SEQ ID NO: 33054 - DNA, 1341 bp, Homo sapiens
actcctgacctcaagtgatccgcccgcttcggccttccaaagtgctgggattacaggtgtgagccaccacgccctgcctcaaacatccttctttactaatcagactgtacctgctctttgaggaaacagactgtgcaccagcttcgggcagcagaggtggagatcaaagatctgcagtccgagtttcagctggagaagatcgattacttggccaccatccgccggcaggagcgtgactccatgctcttgcagcagctcctggagcaggtgcagcccctgattcgcagggactgtaactacagcaacctggagaagattctgcgtgagtcctgctgggacgaagataacggcttctggaagatcccacatcccgtcatcacaaaaaccagcctcccagtagcagtttcaactgggccacagaacaaaccagcccgcaaaacctctgcagcagacaatggcgagccgaacatggaggaggaccgctacaggctcatgctcagtcggagcaacagtgaaaacattgccagcaactacttccgatctaagcgggccagccagatcctcagcacagacgccaggaagagcctcacacatcacaactcgccaccaggcctcagctgcccactcagcaacaactctgccatcccacccacccaggcccctgaaatgccccagccccggcccttccgcctcgagtccctcgacatccctttcaccaaggccaagcgtaagaaaagcaaaagcaactttggcagtgagcctctgtgagcacagctgcttgccattgcctgccttataggcatgtagagactgccaggccctcccagggcagccccaaccaggtctcctcccacctgccacacagcgctccggggcctgagggctccctcagccctgggaagacacattcccttccctgttccccagagagcccacctccgccctgggcaggagcccctcggaggctgtatagtcctccttagagaggcctgctccagctgttcataccacatcagtgtttccgtctgctcacctgccacagagcccacacccatgcccaccagtgttggtctttgcctcaaagcctgagacctgcttcacggccttcaccagccctgatggagagggcagcagctgccacgtggaggaagctcaatatcagctgggaaggaactgtgcctctgtctgactggccccacttcctaagcactgccctgccccatggggtggcacaggggtcccacagcaggtcttcctgcactgcccacccctggctggtctgtggcccaaggaaggccactccacattaagctgcccaataaactgcttttaagataaact

SEQ ID NO: 33055 - DNA, 755 bp, Homo sapiens
ggagtcagatgtagtatagggcactatgaatgctcaccccactgggatgtcaagtggaagaaggacaattccctgaaaagggagatttagattgaagaaaacaagtccataatagtggggaaaaataatagctcttggtgataagaaggtttggattccagttctaatgatcacaaatgtacctgtgagctgaggatagcaacgcattgcctattctatgaacatgtcgtgatagatttggggcttgtgtatcaccccggcccccctgttggagctggcaggacaccctgttttgagctttgtaggacagaataaggcacttcccatctcaaggaaggggaggccgggtgcaggcttggctggagactgacttcctggccccgagctgcctgggatcccacccccgagtccaggatctacggtgtagggtacaccagagtgggcagtgcctgctccagccctgtgacaacttgggggaagctcggggcggcccccactgccccaggataccagaggctgtggagccctgtgccaggggcacaaacaaggggacgtgaccacgggcatctgcatctcggcaggaggaggaccgctacaggctcatgctcagtcggagcaacagtgaaaacattgccagcaactacttccgatctaagcgggccagccagatcctcagcacagacgccaggaagagcctcagtgagtgtccctcccctgtccccaccctctccacacaactgggagaggcgtgaagg

SEQ ID NO: 33056 - DNA, 3157 bp, Homo sapiens
cccggcggggcgggggtcagctctggtcccgttggtcctgggcgcggcgccatggcctccgaggcggtgaaggttgtcgtgcgctgccgtcccatgaaccagcgggagcgagagctgcgctgccagcccgtggtgactgtggactgcgcgcgcgcccagtgctgcatccagaacccgggcgccgccgacgagccgcccaagcagttcaccttcgacggcgcctaccacgtggaccacgtcaccgagcagatctacaacgagatcgcctatccgctggtggagggcgtcactgagggctacaatggcaccatctttgcctacggccagacaggcagcgggaagtccttcaccatgcagggcctgccggatccgccctcccagagaggcatcatccccagggccttcgagcacgtgttcgagagcgtccagtgtgcagagaacactaagttcctggtccgggcctcctacctggagatctacaatgaagatgtccgggacctccttggggctgacaccaagcagaagctggagctgaaggagcacccagagaagggcgtgtacgtgaaggggctgtccatgcacacggtgcacagcgtggcccagtgtgagcacatcatggagactggctggaagaaccgttcggtcggctacacgctgatgaacaaggattcctcacgctcgcactccatcttcaccatcagcatcgagatgtctgccgtggatgagcggggcaaggaccacctccgggcgggcaagctgaacctggtggacctggcgggcagcgagcggcagtccaagaccggggccacgggcgagcggctcaaggaggccaccaagatcaacctgtcgctctcggcactgggcaatgtcatctcggcgctggtggacgggcgctgtaagcacgtcccctaccgtgactcgaagctgacgcggctgctgcaggactcactgggcggcaacaccaagacgctcatggtggcctgcctgtcgcctgcggacaacaactacgatgagacactcagcacgctgcgctacgccaaccgggccaagaacatcaggaacaagccgcgcatcaatgaggaccccaaggatgcgctgcttcgcgagtaccaggaggagatcaagaagctcaaggccatcctgacacagcagatgagccccagcagcctgtcagccctgctgtccaggcaggtgcccccagaccctgtgcaggtggaggagaagctgttgccccaacctgtgatccagcatgacatggaggccgagaagcagctgatccgggaggagtatgaagagcgcctggcccggctgaaagccgactataaggccgagcaggagtctcgggccaggctggaggaagacatcactgccatgcgcaactcatatgacgtcaggctgtccacgctggaggagaacctgcggaaggagacaggtccctgcgccgacagacctgctggagcccagtgatgccaggcccgaagccgaggcggctgatgacttcccgcccaggcctgaggtagatctggcctcggaagtggccttagaggtggtgcggacagcagagcctggcgtgtggttggaggctcaggccccggtggccctggtggctcagcctgagcccctgccggccacagctggtgtgaagagggagagcgtgggcatggaggtggcagtgctgactgatgacccgctgcccgttgtggaccagcagcaggtgctggcccgtctgcagctgttggagcagcaggttgtgggtggagagcaggccaagaacaaggacctgaaggagaagcacaagcggcgcaagcgctacgcagacgagcgcaggaagcagctggtggctgccctgcagaactcggatgaggacagcggggactgggtgctgcttaacgtctacgactccatccaggaggaagtgcgggccaagagcaagctgctggagaagatgcagaggaagcttcgggcagcagaggtggagatcaaagatctgcagtccgagtttcagctggagaagatcgattacttggccaccatccgccggcaggagcgtgactccatgctcttgcagcagctcctggagcaggtgcagcccctgattcgcagggactgtaactacagcaacctggagaagattctgcgtgagtcctgctgggacgaagataacggcttctggaagatcccacatcccgtcatcacaaaaaccagcctcccagtagcagtttcaactgggccacagaacaaaccagcccgcaaaacctctgcagcagacaatggcgagccgaacatggaggaggaccgctacaggctcatgctcagtcggagcaacagtgaaaacattgccagcaactacttccgatctaagcgggccagccagatcctcagcacagacgccaggaagagcctcacacatcacaactcgccaccaggcctcagctgcccactcagcaacaactctgccatcccacccacccaggcccctgaaatgccccagccccggcccttccgcctcgagtccctcgacatccctttcaccaaggccaagcgtaagaaaagcaaaagcaactttggcagtgagcctctgtgagcacagctgcttgccattgcctgccttataggcatgtagagactgccaggccctcccagggcagccccaaccaggtctcctcccacctgccacacagcgctccggggcctgagggctccctcagccctgggaagacacattcccttccctgttccccagagagcccacctccgccctgggcaggagcccctcggaggctgtatagtcctccttagagaggcctgctccagctgttcataccacatcagtgtttccgtctgctcacctgccacagagcccacacccatgcccaccagtgttggtctttgcctcaaagcctgagacctgcttcacggccttcaccagccctgatggagagggcagcagctgccacgtggaggaagctcaatatcagctgggaaggaactgtgcctctgtctgactggccccacttcctaagcactgccctgccccatggggtggcacaggggtcccacagcaggtcttcctgcactgcccacccctggctggtctgtggcccaaggaaggccactccacattaagctgcccaataaactgcttttaagataaact

SEQ ID NO: 33057 - DNA, 2974 bp, Homo sapiens
cccggcggggcgggggtcagctctggtcccgttggtcctgggcgcggcgccatggcctccgaggcggtgaaggttgtcgtgcgctgccgtcccatgaaccagcgggagcgagagctgcgctgccagcccgtggtgactgtggactgcgcgcgcgcccagtgctgcatccagaacccgggcgccgccgacgagccgcccaagcagttcaccttcgacggcgcctaccacgtggaccacgtcaccgagcagatctacaacgagatcgcctatccgctggtggagggcgtcactgagggctacaatggcaccatctttgcctacggccagacaggcagcgggaagtccttcaccatgcagggcctgccggatccgccctcccagagaggcatcatccccagggccttcgagcacgtgttcgagagcgtccagtgtgcagagaacactaagttcctggtccgggcctcctacctggagatctacaatgaagatgtccgggacctccttggggctgacaccaagcagaagctggagctgaaggagcacccagagaagggcgtgtacgtgaaggggctgtccatgcacacggtgcacagcgtggcccagtgtgagcacatcatggagactggctggaagaaccgttcggtcggctacacgctgatgaacaaggattcctcacgctcgcactccatcttcaccatcagcatcgagatgtctgccgtggatgagcggggcaaggaccacctccgggcgggcaagctgaacctggtggacctggcgggcagcgagcggcagtccaagaccggggccacgggcgagcggctcaaggaggccaccaagatcaacctgtcgctctcggcactgggcaatgtcatctcggcgctggtggacgggcgctgtaagcacgtcccctaccgtgactcgaagctgacgcggctgctgcaggactcactgggcggcaacaccaagacgctcatggtggcctgcctgtcgcctgcggacaacaactacgatgagacactcagcacgctgcgctacgccaaccgggccaagaacatcaggaacaagccgcgcatcaatgaggaccccaaggatgcgctgcttcgcgagtaccaggaggagatcaagaagctcaaggccatcctgacacagcagatgagccccagcagcctgtcagccctgctgtccaggcaggtgcccccagaccctgtgcaggtggaggagaagctgttgccccaacctgtgatccagcatgacatggaggccgagaagcagctgatccgggaggagtatgaagagcgcctggcccggctgaaagccgactataaggccgagcaggagtctcgggccaggctggaggaagacatcactgccatgcgcaactcatatgacgtcaggctgtccacgctggaggagaacctgcggaaggagacaggtccctgcgccgacagacctgctggagcccagtgatgccaggcccgaagccgaggcggctgatgacttcccgcccaggcctgaggtagatctggcctcggaagtggccttagaggtggtgcggacagcagagcctggcgtgtggttggaggctcaggccccggtggccctggtggctcagcctgagcccctgccggccacagctggtgtgaagagggagagcgtgggcatggaggtggcagtgctgactgatgacccgctgcccgttgtggaccagcagcaggtgctggcccgtctgcagctgttggagcagcaggttgtgggtggagagcaggccaagaacaaggacctgaaggagaagcacaagcggcgcaagcgctacgcagacgagcgcaggaagcagctggtggctgccctgcagaactcggatgaggacagcggggactgggtgctgcttaacgtctacgactccatccaggaggaagtgcgggccaagagcaagctgctggagaagatgcagaggaagcttcgggcagcagaggtggagatcaaagatctgcagtccgagtttcagctggagaagatcgattacttggccaccatccgccggcaggagcgtgactccatgctcttgcagcagctcctggagcaggtgcagcccctgattcgcagggactgtaactacagcaacctggagaagattctgcgtgagtcctgctgggacgaagataacggcttctggaagatcccacatcccgtcatcacaaaaaccagcctcccagtagcagtttcaactgggccacagaacaaaccagcccgcaaaacctctgcagcagacaatggcgagccgaacatggaggaggaccgctacaggctcatgctcagtcggagcaacagtgaaaacattgccagcaactacttccgatctaagcgggccagccagatcctcagcacagacgccaggaagagcctcacacatcacaactcgccaccaggcctcagctgcccactcagcaacaactctgccatcccacccacccaggcccctgaaatgccccagccccggcccttccgcctcgagtccctcgacatccctttcaccaaggccaagcgtaagaaaagcaaaagcaactttggcagtgagcctctgtgagcacagctgcttgccattgcctgccttataggcatgtagagactgccaggccctcccagggcagccccaaccaggtctcctcccacctgccacacagcgctccggggcctgagggctccctcagccctgggaagacacattcccttccctgttccccagagagcccacctccgccctgggcaggagcccctcggaggaagctcaatatcagctgggaaggaactgtgcctctgtctgactggccccacttcctaagcactgccctgccccatggggtggcacaggggtcccacagcaggtcttcctgcactgcccacccctggctggtctgtggcccaaggaaggccactccacattaagctgcccaataaactgcttttaagataaact

SEQ ID NO: 33058 - DNA, 607 bp, Homo sapiens
tttttttttgtagagacaagacttcaccatgttggccaggatggtatcaatctcctgaactcatgatctgcccgcctcagccatttttagatgagagaactgagggaaagagagggaaaggtgcatgtccagaggcacataggtagttaagtgatagagctggaatttccacccaggtagtctgactttcaaagccctgccctgtccactccatgacaactgcctctgcatgaatgcttcaacaaggtaatatgtataaagtgcataccctgcttgtcacttagaaagcactgactacggccgggggtggtggctcacgcctgtaatccagcactttgggaggccgaggggggcagatcacaagatcaggagatggagaccattttgcctatctttgatagtgcatgagatcaacatgctctaaaatgtttcgcgactttgaaatataaatttacttacaaatgtttactcattgctattttgttcatggcattgtggtattaaataactggaaggaagagtaaaacttcttggcatccagcagtttatttcattgtgagtagtcaaagtcttaaaggtacaaggagtggtcgacgcggcccgcaaa

SEQ ID NO: 33059 - DNA, 306 bp, Homo sapiens
ggagactaaaaattatttgcagataataaaaagttcccaaggcaatcaactaaaatgtagtttagtagggttccactgtaaatcatgtaaatatcatgatcttttgtgtatgataataataaccagtttaaaagtatgaggaaaaaagcccattcatagtagcaacaaaaaatatgccagggattaaactcggtaagaaatgcaattggcctgtagaaaggaaactagtgaactttgctctgaagataatgaggagacttatgtttctggataggaagacaattctttagttagttttaatatttt

SEQ ID NO: 33060 - DNA, 580 bp, Homo sapiens
gaaagctgaagaggccagatacttcttttgccagaatcccttgcagcgagggtgagggacatgacctggacttctgctaatcagactgatcagacactcctgccatggactttggatctaaaaagccagagtttcgccctgttgtccaggctggtctcaaactcctggattcaagtgagccacccaccttggcctcccaaagtgctgggattacagatatgagccactgagcccagccaaggccacagtatcttaatctctagccatttgctttaacacctacatgaatgtcaagcaactggtaatgtggtcttcaaccctaagcagatggaccaaaccctgaaaaatggagaagcaacaaataaaagtgtcatgcaattattgaccatggaataaatatacagaagaccaagagaaattcagaaatcataaagcatcgatattgcactccagcctgggcaacaagaatgaaacatcatctcaaaaaaacaaaagtttactcttttatctcaaaagtttattgtacgatgtaaatcttcagctttggcaaaatactattttaaacactcaaccattctgt

SEQ ID NO: 33061 - DNA, 506 bp, Homo sapiens
gcaaagactgatattggtatggacgtaaagaatcattaatgaagcaagatttattttttgagaaagattgtcaatgtgaaatgcatgctgatgaaactagagtttgttcttatttaggttgctgatctttgagaaaataattgaaacagtatcaatcatgagcattatcctattagcacaaattcagatgtttaccagttgaactatgctacaaactcttgacttcacttgaaaactcatctatggaggagtatggctcagttgaacaaaaagtgacagaccttaatccttgtcaagtactatcccagatataaggagggcttgtcatggttgcagttctcaaggagcttatagaagtggaaagacacacacataagaaaaataattttagtataatatggtaaatgataacatagtgttatgtaaagacagacatgataacgtgaagtttagtggcaaatttcttagagatggtatttgagctaaaacttacagaatgagaaaaa

SEQ ID NO: 33062 - DNA, 223 bp, Homo sapiens
ttttcctttttagaaaaatgacccaacttgggatgttttcttgggttgaagttttatttaggaaaataaaccccaaataaaaacgatgttgagaaaatgggcggggggggagaaaagaaaatcatacactgacgttagctaaaatagaaacttccatcacccttaagccagtttgtcaatagttattcaacgcctgctactctaatcactggcttcctaaaat

SEQ ID NO: 33063 - DNA, 428 bp, Homo sapiens
ttttttttaaaggctaggtctcactctgttgcccaggctggagtgcagtagtgtgaacacagctcattgcagcctcaaccttctgggctcaggtgatctgaaaggtgtcactttttattatttaaaattcacttctcttttaattttgtggttggatcctaagagtagagcacgtgagccagatttaaattgtattcctttggtcacagtgattggctcaggggtgaacttatggtgtaagaagaaccaatcagaggaaaatttggactgtctctgggaaagtggaatctcaaactggagaacaaaaacattaggctccttgggacatggttcgaatcctgaatcaagtcttacctggtctgtttacttacataagacaatacattctctttttttgatttagctctttggagttcagtttttgttat

SEQ ID NO: 33064 - DNA, 1745 bp, Homo sapiens
caggtctccaggggtcaaaccacaccccacaggcaccttggaagaagaaatccacaggaggaaaaaaagaaaaaattctcaaactacaggaagtggagagaacagtacagtgaccctacacgcttgttaccagcctcacctgtcacccacatggagtccttcccatttgtggggtttccaggatttgctgagcacctactatgcatcagacgctgtgttctaggcaagggggatacacctgatggaagaaggtccttccctagacgtagctaacatcccagtgtgggagatgatacgaaacagcaaactccccacaacagcctcctcaacgctgcctcccacagtgcttggacaaaataattacagcaagatgcgggcaactgagctgactccttatgtaggacatcccagtgcaggtagagaaactgagggacagttggaggttccttgcccttggtgatcggtgagagggcctgcaggcaccagcccggccgcaccgcaccgcttctcgcggaccccagcggagccgcgcttctcgtgccgctcctgagggtttccgcggcgccggcgtttttgttcccggcgcgtttaagtcgttgaggccgaatcaagcgaaggcggaaaagcggcgcgcagcccgcgtcagctgcagttccgtccccctggttcccggtgcgctaacaaaggcatttgcatgaaaacaggaaccccgtctgcagaaaggactcgttggcggggtgcatcgtgcgctccagtgcccctaccgcggcgcccgctccccaggtggggaagaagcggggtgcggggactggccccaaacacggctcggccggcggggaccggcacgctgcggcccgggcgacccccttctccgcccctttcccaggccggcggaaacggccgtctcgggcgtgggcgcgcttctgcggactcctcgggaccttttacccaggcgtgcggccggggcgcccggggcctcggggagccggcgccagcgtgcggagcgcagcggagcggagggagcggcgggagcggcgtccgtggctggtccaggtctggggcgcagcctccaggctcgccctgcgccgctctgggcctcggcctcttcgcctgttcgaccggggcgcaagcgtgtcacagcgcctgtctgcagggggaagcgggcttcccagaggggcgcgtggctcgcagaggggctccgggaatatccgctccgttggccctttccagagcttttccttagctgcttctcctttgaaatccgcctttttcccagcagcccttggaggcaggataaattaagtggtaaaagcagaggattaggaaccgggaaccctggattcaaatcctgcccgccgctgaccagctttgtaaccatgagcaggttactccgcctctggaggcctcagcttccccgtctgtaaaatggggcctaacacagtccagaaagtgcttagtgccgcagtgtcacacaccgagtgcttaattcattcttaaaattatcacttccagctgtgggacaggcgcagggtagaaaggggttttcttaaggtcacaggcggggtcaaaggcaaaccctccgggtcctcacaagtaagacttgcgaagcagcaagttccccaaagggtcttatccagccgggtaaggagcgccggggcatctcccccctctctctccgcgaagacgcacaagcaatggctggcgaacctactgcctggaatggggttcttgggtcgagaccttta

SEQ ID NO: 33065 - DNA, 817 bp, Homo sapiens
ccaggctgggcccaatattctcaagtgccgagcctacctactgcgcacttgaggctattgttcaacctggttccccacatatcgtgcaacctgttgtttctccacctatcgtgcaacctgtttctccacatattgttcaacttcctatttcccttcaatagattattcaaccagcattttcctatctgtacaagggagtgaggattacatgacctaatgtgcatatagcatagagcagagcctggcataagcgctgcattggtgtttgctacgatattaacacttgttgctatttgaaattattttgtctgtatgtttcttgtttatttccctcttctctctgacaggcaaactccccacaacagcctcctcaacgctgcctcccacagtgcttggacaaaataattacagcaagatgcgggcaactgagctgactccttatgtaggacatcccagtgcaggtagagaaactgagggacagttggaggttccttgcccttggtgatcggtgagagggcctgcaggcaccagcccggccgcaccgcaccgcttctcgcggaccccagcggagccgcgcttctcgtgccgctcctgagggtttccgcggcgccggcgtttttgttcccggcgcgtttaagtcgttgaggccgaatcaagcgaaggcggaaaagcggcgcgcagcccgcgtcagctgcagttccgtccccctggttcccggtgcgctaacaaaggcatttgcatgaaaacaggaaccccgtctgcagaaaggactcgttggcggggtgcatcgtgcgctccagtgcccctaccgcggcgc

SEQ ID NO: 33066 - DNA, 356 bp, Homo sapiens
tatgatatggaaaaccaaacttaatcaactaaaaactatttagaagcaatggagaaatttaggaagatgactggcttattaaaaatatgaagttaggtcattgaaaagcataaaagaatccaacaaaaaataaaaattaaaaaatgaagtcagccgagcacagtggctcacgcctgtatccccagcaatttgggaggccaaggcaggtggatcacctgaggtcgggagtttgagaccagcctggccaacatggtgaaaccccatctctactaaaaatacaaaaattagccgggtgtggtggggcatgcctgtaatcccagctgcttgggaggctgaggcatgagaactgcttgaac

SEQ ID NO: 33067 - DNA, 763 bp, Homo sapiens
gagaatgagccctggtgtagtcattgccagtttgggtggaacttttaaaaatcaccagttcatgatttgaatagggaaggtgtgaccactgagacgagaaccagcattattttccagagatggcaaaatagagcttgagaagctggccaaagagaagatgaaatgaatgctggttgcacagtgttcagtatgtagacatcaagggattctggccctgttagatatgttagaggaaaggtttgtttaacattaatacaatgtgctacaggggaagtgttgtcaaacagttatgccggtttcttaggtaaagttggccagtattcttcttgcaggcctagtttgcttcatcattaggataactgtatgcattctcattggagcctattatccagatataattgttaattatgtccattctttcattctcaaaattgatttggtttggaccatttatcagtcctgggtagaaatgcacattttctgactttctgactgtctgtctctgtggagagcctctttgtatgacaccagctctgcagcaggagtgcttgtgcacatggccattatgagaaggccagttagatttcaggagtcatggggactgtgaggacctggaatacccatgcccagtataaaggtaattcaagttcagatctgtgcaaaacccacgctggatgcaaaaacacatttgctggccaaattcagatcacaggcacctggtaggttcatcttcttctttatagggaactgttaatgttctaga

SEQ ID NO: 33068 - DNA, 384 bp, Homo sapiens
tttttttaattttgagatgggagtcttactgtgtagcccaggctggagtacagtggtgtaatctcggctcactgcaatctccacctcccaggttcaagcgattctcctgcctcaacctcctgagtagctgggactacatggctgcgtcaccacgcccgactaatttttgtaatttgagtagagacggggtttcactgtgttggccagctggtctcaaactcctgacctcaggtgatccagccgcctcagcctcccaaagtgctgagattacaggcatgagccacggcgcccggcttccctctccttttttaacccaccttgctcttcaccttaggtttttcacttgacaatatatcctgattatttccgtatcaataaattagt

SEQ ID NO: 33069 - DNA, 378 bp, Homo sapiens
tatacctactggggctcgattccttaggtttatgccctgaggttaccatagagagttttgatacttcacatcagcgttacttttttttattaatcattttattatgaaaaatttcaaacatgcagaaaagtttaaagaattgtacagtgaatgcctgtaatcacctagattctacaatgaacatttagctctagatgatcagaaatctatcaatccatctattgactctgtatttttctgttagatgcatttcaaagtaagctaagccatcagtgcactcaccctaaagactttaggatgtatatattaaactgatattaacttgaggttctttctttttttattgtgaggtcaaatttacatagagcaaaaaaaaca

SEQ ID NO: 33070 - DNA, 874 bp, Homo sapiens
tgacctctcagcaggcatctagggttggcaggtagatagttcaagaaggaacgaagctgctgcagttgaggggtggggttgtccatcctattttctcgtctcaagcaagatggcacagtatcgattcagcagtatttactagaacccactctgtgctggtcggaggttactaagacagggtcctgggatgttcattctctaagtctttcctccgctctgtgacccaccctccttccccttttgagatctggtatttgatgcccaacacattgtccacgctgtgacgtgaccatcatcatagcaggcagagggcgcctctgctgctgaaggcctgtgattttgtggggaagggcctgttctagcaactggaaaggcactgccacctgccgttggatgccaggactcaagagctggccccagtcactgtgcgcagagctgtctgagaatgtgtgagtggactgggtccttcggcactgcctgcattggctcagggcagtcaaccgtcgcagaggatgaggggcacactcaggcagcctccccggccctggaggcagaaaggcccaggcagaaccactgactgggaggaaacagaaaaagcagaggagagccaggctgcaggcgtgtggatgggaccagctcaggcagacgctgtctcatacccactctcccctctcttgccagggcctggcctggtgtctctcaggagcctgggcatgagacaaaagcagagattgttctcttgtggtaccacaggctgtaaccagtccacccagtgttgttttagaaatttaaatcggttgcccatctttttaaattggcaacatcgtttaccacattaaaatctagatgccctgcttctcttgaaaatgtcaaa

SEQ ID NO: 33071 - DNA, 443 bp, Homo sapiens
gcaacagctgacatgacagttctgctgtccttcctggggttctaaaaccatgatctcttcaagaatgaggcttcgccaagctccttgaaacttgtttggttggtttctaccatagagctacttatgcagatactcaaatagagaaatcatggaagcagagcagtgaaaagttctcagatatcatctgaaccaatacctgtttctacagatgagtgtactgaggttcacagaggttgaatgacttgtccaagacacacagctggtttgtgacagatctaagaccagaactgggacctccagttctgatggaaacttcaggctacacagatttcaaggccaacagttgaggtttatatttgtgttaatttagtcaaactaagtatgacttaagtaaaatgaagtttaaatgatttgtttatgaaaaataaaatttaataaataga

SEQ ID NO: 33072 - DNA, 376 bp, Homo sapiens
ttctccatttgtttccccacttctactgccaatcagtgcaagaggcaatatggtgatagtttatgtctatgggtgctcagagaagagtgaaatggtgggaacagctggattgtcattgcttggtgcctgattagagaaatgtattcttgttgtacattagagaccagaataccttttcctatagaaacaatatgagaaatgagtgtagattaaaaagacgttttagattagctgggcatggtggtgcatgcctgtaatcccagctactcagaggctgaggcacaagaatcgcttgaacccaggaggcagagggttgcagtgagccgagattgcaccactccactccagcctgggtgacagagtgatactcggtctc

SEQ ID NO: 33073 - DNA, 365 bp, Homo sapiens
cctcctatgacttaaaatacctaacctcctggaaattcagcccagtgggtctcagcctcattttacccagccccccttcaagatgggagttgtgcttgttcaaaggcccctgacatgacgatgctaaaatctccactcagggaggagctatagctcatgaccatctcatgagaccttatactggcagaacggctcagtgcatgtgtgccactgaaactccctcctctacatgtggtgacgcaccctctcccctctccatggcctcagaaaaccctcctgtcactttgcctcagagagacactgctttggagaatactccccatggcctccttacttgagtcaagtagtaaaacctctactgacga

SEQ ID NO: 33074 - DNA, 493 bp, Homo sapiens
aaccccatctctactaaaaatacaaaaattagccaggcatgtggtggacacctgtaatcccagctactcaggaggctgaggcaggagaatcgcttgaacccaggaggcagaggttgcagtgagctgcgattatgccactgcactccagcctgggtgaaagaaactcagtctccaaaaagactgtcggagtggactgcaggagtcaggggcgagacacacgacactcaatttgcagcatgtgcccaatacacaacagccagtgtgtcagcagggacgctgcccccagcagtggcttccctgcccacgggggctcttccagggcaggagcatctgatgggaagctccaagctgccaaggggggagatggggaaacaccgtgttttacatttggactgtcctgcaacagtgcacatgctccttctgcagctaacaggccatgggagaccgtttcctcctctcccaaactgggccaatgcctgccaggaggggctgg

SEQ ID NO: 33075 - DNA, 295 bp, Homo sapiens
gtccctctttctcaatctggttttggtatcagggtgatggcttcataaaatgagttagggaggattcctgctttctcaatcttttggaatagtttcagtaggattggtataaattcttctttgaaagtccggtagaattcaactgtgaatccatctggccaatctgaccataaccttttcttggttggcaatttttaagttactgaatcaatctcacggctcattattggtctgttcagggtttctatttcttcctgatttaatctaggagggttgtatgtttccagaagtttat

SEQ ID NO: 33076 - DNA, 616 bp, Homo sapiens
gataagtatcactgctcagtgtaaaagacagcaaatcaggtaggaaatcactattactgaatacatttggcagatctgggtgccaacattgctctatagcttatgatgctaagatgggaaaaagacgcggtgtgtgattgagaatgatccattaattgatcacttgactgatcttcaagcagggaatgaaacaaatacttgaggtaattacaaatattttccaaagattcataataatatgactcatataagaaaaatacataatgcattttaaatatatattaattctgtttttatattatgacatctcattctgttcaattgttcaatttaaatttgaatgttatttgggtggctttattctaacaatttggcaatttactagggtaataaaagaattcattttaactaataagtgctcacaaaaagctttgtatattagagttaagttttattgaatttgaacctggtctggcattacattgctatttaacagataccgcatttatcatgttatattatattcattgcctgtgcattagcctcaccgtttcctcaaatgcactttggaaaagtatttaaaggagtgttcatttggataaaatgcatgtttatt

SEQ ID NO: 33077 - DNA, 316 bp, Homo sapiens
ggaagacaccttggaggccttctcagaatttcttctcagtgcctgtgactcgctgtgtatccccatggtgatggtgggttctcctgagccacgggcaacatgaagcttggggaagagaagaatgtgcaggcgagccaggctcagaggcataaggcagtgactgctcaaaggaactctctgggggcctcagcagtgcaattcttgctgctacctttcctttgttctaaaaataaaatgtagtgtttgattatgaaactaacaggttcatcttaagaaaaaatagaaagcagtaataataaaataataagtgggtaag

SEQ ID NO: 33078 - DNA, 474 bp, Homo sapiens
actccattgagttaataaaggtttaaaataagaatttagtcattactcctatcattctgctgaggtagcctttaaatagttctgtaccttaattggtgcccataaatgaaaaaaaaaaaagcatgtgtgtttgtatgtgtctgtgcctgtacctgctttcagaaaaggctattataatttccttttacaccaatagtgtaagagtaccttttacctgatagtctatttactattctacgttcttgcccattcattgatattaagcaatctcctttttactttagtgtccatttccatgattgccagagtttgagcacctttatgtttattggctgttggattttaattgttaaatgtgtgacttttatagctttaagtttgttttagttaaaagttctgtcttatcccaacttagatttttcatctgaaaacctttttttaaaaaataaaattaagtctttaaccatcaaaaaa

SEQ ID NO: 33079 - DNA, 579 bp, Homo sapiens
agaattttagggatcaaatgagttcctttggatactgtgcctgtttttgactgaacagctgtcttctgacatcctgagtggcttctttagcttagttgtcacctcttctatagcctcatcctgcctcatgacaaaactttacttctgcctgttcattgccttgtgtgtacataataatactgcagttgtccttgtcacaatgattgtaacctatttcttacatgtcacccttactcaactgcgagatgcttgagggtaaagactctctatacgaggtgtctgaagcataaaaggtattcactagattttcagtcagttttttggtattcattaaaaagaacttcattttgcgtttaaactgtttaaatttctaaatcatgaactttgtacttgctcacaaattttaggatagcattatttctgcatggtctaatatttattttcttaaataactgaccaggcatggtgtctcatgcctatgatcccagcactttgggaggctgagacaggagaaaggagaatcacttgagcctaggacttccagaccagcctggtcaacatagggagaccccatctcta

SEQ ID NO: 33080 - DNA, 635 bp, Homo sapiens
ccatggcagacatcattaatggattccagcatacttcctcaccaagttgggacatgtcctcagaagcctgcttagcttcttagccactagcaagaaggcagacttaccttctggggagatgccttctgctgaaagctagtcattctgacagggcaggctggggccctccagaaaagggtcttgaactttggccttggaactaaatctccgtttcctcatctgtaagcgtgtgtggttctcacactgtggtgtgctccggaatcaccaaggggaggtaattaatatgtgattcctagtccccatacccagaactctggaatcagaatctctaggggtggtgcccagaccctatattttaaacatgccccgagggatcatgatcttgccaaagtttgaatatcaccatcttaggccatttcttgatggtttctacaggagagagtccggaacgctgtccttccaaggcaaggcctcaggctcattcagatcaggcctggccactcctctttggagggcggttgaggcccacctgccttgggcttcccaatcctgattcccccactacacccttcccagttctattcccctcaccacacttgctccaataaaactatttatatacagataaaaaaaaa

SEQ ID NO: 33081 - DNA, 310 bp, Homo sapiens
tttttgtagggggaacaggctctcactctgtcgcccaagctggagtgcagtggtgcgatctcgactcactttaccctggacttcctcgggctcaagtgatcctccagcctcagcctcccgggcatctgagactacatttgagtctacaggcgcgcgccactaagcctgagtaattttgttgttgttgttgttgttgttgttgttgtacagacgggggtcccactgtgctgtccaggctggtctcgaacttcttggctcaagcgatgaacccgcttaggcctcccaaagtgctgggatttcataggcgcga

SEQ ID NO: 33082 - DNA, 383 bp, Homo sapiens
ttcacctcatgagacatataaatcaagtaacattcgttattgtgattagaaaagctgcatttacacacgttagccactagatggggacgtgcgattgttacaatgctgaaggtttcccgtatttctttattttttatttggccgctagagggcacgcctgcactgcacttaaagttgactactttcaaggaaagacaaaggaattcttggatttctccattttcctcatcacctgtgcttatcagagaattccaggggcaagctaccctttccaattcatcactaacttataaacaaaattctaaggagtaaggaatgcttcttacttacttcctataacatacgtaagaatgaacgctcaaaataaaagtaatttatttaaa

SEQ ID NO: 33083 - DNA, 707 bp, Homo sapiens
agtctcctcttcacgtcccagcgcgggtgggcgccggcggctcctcttaaccacaggttccagaagtcctctgcagaagtgcttccctctctcatttccaggaccacaattcccagagacttcggcttcacgacgtttctctttttgcccgatctctcccggagctggctgggcttcggccggccagaggcccacagcgacgacgtgatccgtcgtgagcgggtcccagggtttcctcggcggcccttttttctctcccctcggtcgtcccccttgcaggctgtcgcggctggcctgagcggtgacctggcgggtcgcgcctgcgctctgccctgtttcctgcctggctggtggcggcggccattttgttcatcctcctcctcctcctgctcctcctggttggagcgcagtgtccggagcgggctggggggagagagcccgagagcagggttcggtgccttttcctctgtccccagccggtgcccagagccacacaagaaagaacaagaagaaggaaaaaagcatgtggaaagctaggagcgcacgaagaacaaagcaagcaagtgagaagaataacgacgcacaatccagaagcatagaacaacccacaaaaagaattcacgaacaaaagacaactaaacaaatgccccgcgcaacccgagaaaaaaagagcgccaggggagaaacagaatggagtaaaaaacacc

SEQ ID NO: 33084 - DNA, 708 bp, Homo sapiens
agtctcctcttcacgtcccagcgcgggtgggcgccggcggctcctcttaaccacaggttccagaagtcctctgcagaagtgcttccctctctcatttccaggaccacaattcccagagacttcggcttcacgacgtttctctttttgcccgatctctcccggagctggctgggcttcggccggccagaggcccacagcgacgacgtgatccgtcgtgagcgggtcccagggtttcctcggcggcccttttttctctcccctcggtcgtcccccttgcaggctgtcgcggctggcctgagcggtgacctggcgggtcgcgcctgcgctctgccctgtttcctgcctggctggtggcggcggccattttgttcatcctcctcctcctcctgctcctcctggttggagcgcagtgtccggagcgggctggggggagagagcccgagagcagggttcggtgccttttcctctgtccccagccggtgcccagagcccccctccccttcctccccaccccctcccctccccaaccctgccctcccccttgtcccgggatcgctccgtcgcacccaccatgatggaagacgacgggcagccccggactctacacacacaagctaagacatatggttctatcttcagaaaacaatatggtgtttagagcctacatacgtaggtaacctttccagagatgtgacagaagtccttata

SEQ ID NO: 33085 - DNA, 1023 bp, Homo sapiens
gttttctctaggtaatttaacttaaagggacagtaagtatccacatcttccttgctgcttgtttaggattgaggttgacacatacctcttagaaggccggacgtttggtcactggagcagcagtgctcggcgactctccggagtgccccctctggctttccgctcggtcagctgagccgcacaagcagcagtggcgctgcccctacatggggcatgctttgcagggctgaggttttgcagttcccaccattgagggctgtaacatttctctatttctggcttagaatgtgtgtaggatgataattatttattcagcattcattccgctcacgctgtgctccgaccacacaccaggctctgcgtgcggtgctggcacagtctcaggactccgcttctcagctgtagggctcagggtgcagtggagaaggcgcgaaggggctgcccgcggatggatttgttcccttggcctttcactgttgctcctctcactctcttctcctaaactcggcgtagaggagcatcctcaggagaaacaggaagaggcaaagttcactgcaaagttttttttgggttgaacgcctgtaggataagaatagcagagggcacccccagatgagatgcggccgtggtcgagcatcaggatcgtctgcctgcgcccaccagtgtggtccgggagcagggaggtggcagagccaaggccgcgcccctccccgcgggtctcccgtgctgctcgctggcggttggtttcatcagtgccctggcgagtgtcgctggttgcgacggggcactgcccacacagagcgaattctcaggcaggcccccttcctctctctccccggaagctgcttcatggcactccctccctttcccttggccgtgggaacctctaggttgatcactgggtcattggatctgcttttagttagccttgatttttgtctgcattaaacaattaaatgagcttctaataatacggtgttttgaatgtcatacatggcttttcctgttgaaacatctgcagaa

SEQ ID NO: 33086 - DNA, 332 bp, Homo sapiens
tttttgttttactagtgccacagacttgccagtggtaacttatttaccccattcaagataactctgtagttttctttcctaggacttgttgttaaacgtcaaaagacatttttgagctgtatgtttgatcagactgttagcttttctgttttatttcttttaagaacctctgaataaaaaacatctgaaattgaaaaaaaaaagaaattaaatgtgttttgttttaagctgctaagttttgtggcaatttgttatacagcagttgataactaatagtagttccctgcagtctgccttttcattctggtctctctgcacttcagagtgcctgc

SEQ ID NO: 33087 - DNA, 550 bp, Homo sapiens
attttgccttgtaataactatcaatctagccattaagttccaaagaaccttatttccacagcctgtggttttgtggggaggcttttgttttattcagttttggtttgggttcttatagaacagctggaactatagagcctggacttagagaaagagcttggggagacggagggggagatgtcatgttggatgtccttatgacattcggttatatgattgaaaccatgggactggagatgatatcactggtgagaatataaaaagggaagagagaccaggctcagtggctcacgtgtgtaatctcagcactttgggcagccggggtgagtggatcacctgagctcaggagatggagaccagcctgagcaacatggtgaaaccccatctctacaaagatacaaaaattagctgggtgcggtggtgcacacttgtaatcccagctactcgggaggctgaggtgggaggattgcttgagcctgggatttggaggttgcagtgagtggagattgcaccactgcactccagcctgagtgacagagacagactgtct

SEQ ID NO: 33088 - DNA, 329 bp, Homo sapiens
  misc_feature (220)..(220): n is a, c, g, or t
gattctccctcaggaagacccagtgtgaatagtgttacatttataatccataaagagagaagtaacagctctgtggatcaaaaagcctgggttctctgggcaatttgtgaatgtcctggtcaaataaagtcacttcagtaacttgtgagaaggaccaatagaacagataagacagcacacccagcacctcatctaacatttgagtaagagaaaagggctngaaccacaaaataattattttgctatacacttcttccttagatgtgcgtctggtgtcttggagagacttctgttatattacacagtatggttactctgattcacacgcc

SEQ ID NO: 33089 - DNA, 178 bp, Homo sapiens
gctccattccgaaatgatcatttgggggtgatccggggagcccaagctgctaaggtcccacaacttccggacctttgtccttcctggagcgatctttccaggcagcccccggctccgctagatggagaaaatccaattgaaggctgtcagtcgtggaagtgagaagtgctaaaccagg

SEQ ID NO: 33090 - DNA, 219 bp, Homo sapiens
ttttttcattttctcagtcctcctaaaagctgctctaattaaagtcccctgtcactcagctcagctcttagcaaacgagtgggatttggtacagctgtctaggatttcacggatgtgctgcacacttcagccctcatgttagttcagtcatcagcggcgaaagaagctttcctttctcttgccaaaggcagcatctgaagagttctaaaagatgcaaaa

SEQ ID NO: 33091 - DNA, 213 bp, Homo sapiens
gaatataaaaaatgaaggcaattccttgtctgttctgaaaaatgctaaatgttttttcctttccctgagactatgaatttgaccatgtttagagatgaagaactaggcgtgatgtagttccagcgctttgggaggccggggtgagaggatctcttgggcgcgggagtttgagaccagtctgggtgacggggagagactttgtttctacaaaaa

SEQ ID NO: 33092 - DNA, 832 bp, Homo sapiens
tcacatggcaagtggggaccagacaggactgaggccaggactctggtgacaggacccccaggcctctctgccctactgctctctcttcacaccctcctcccccatctttcctggatttccccacatcagcctaccagaaggtagagagaagaagaaaagaagccacatcggagtgtccatgaaaagtccagcctccctgtgggatgtaaaatggtgcaaccaccttgggaaagagtctggcagttcctcaaaatttaaacatcaaattgaacatatgacccagcaattccgctcctaagtatgtccttaagagaggtgaaaacatgtgtctacacatgaacatgtacatgactgttcatagcagtattgttcataagagccaaaaggtggaaacaagccagatgtccatcaaaggttgaatggagaaacacaatgtgatttattcatgtaagaagatattatttgaccgtaagaaaggaagaagtactcacacatgcttcaacatgggtgaaccttacaaacatgctaaggagctagtcacaaagaccacatatgttatgattccatttaaatgaaagcccaaatttggaaaatctatagagatagaaagtaggttagtagttgccaagggctgggtgaaggagagactggggagtaattgccgatggacatggggtctctctttgcaggaatgagaatgctctagaagtagtggtgatgagtacacaacttggtgaacatactagaaaccactgaatcgtctgttttagaagactgacttctatggtgcatgaactctatctcaatacagctgttatttttttaaaaagtc

SEQ ID NO: 33093 - DNA, 977 bp, Homo sapiens
cattgtagaatagcagttcagacacaggccttgatataaccgtgtgagggtgatggcctttcccagccgtggttcctcacctgtaaagggtgaggacagcagcacctgcctcagggggtgagaaagcatggccctcagtagtcggtagtggctgccgtcaggttcacagcgtacctctcccgattttagatgaggaaactgtggcccgaagagtcacatggggttttctggcaaaatccctcttgttttagtgggttctatgtttatactgattcctgggatagataagtctgtcttctccacataatgaaaataaaaaactttaattttatacagtggcagttactttagccactttaaaagttaagaagtgtcagtacagccaagaaaaaaaatcagcaaaactacaggttgggaaaaaatattttccaaaccatatatctaatgatatcttagtatctaaaatagcaaaaaaaataaaaaataaaaaaaagccctactaaaaccaacctactaaaccctactaaaaaacaaccctactaaaaatgggcaaaggacttgaatagatatttttccagagaagacatacaaatggccagttgatgtatgaaaaaatgctcaacatcaccaagcaccagagaaatgcaaattaaaaccccaatgagtatcatctcatctcgctccagttagagtggctgttaccaagaggacaaaagatagtgttggtgaggatgtggagaaaagggaaccctgtgtgctgttggtgggaatgtaaattagtacaactattgtggaaaactctggaggttcctcaaaagtcacaggactaccatgtgctccagcaacctcatttctgggtgtatatccaaagggcatgaaatcagaagctcaaagagacacctggacccccatgttcattgcagcgttattcacaatacccgagatatggaaacaacctaaaaatttttggtgtttaa

SEQ ID NO: 33094 - DNA, 1280 bp, Homo sapiens
tttttctttttacaaaaaacaattgttatttgtgtacttttaaaacctcacagtaatattttcacactaccttcttggctgaaagttcacactcggaattccagagcagtccatggccaggccactgggctccccttgctctctccttggctttggtaaccactggccccagggactcagcctgctttcctatccatcccctcagtagctgtcaccatgcaggttaccccttctgtttcttctaccactaactccatgtctgactgcaagtgaaaggaacagaagcccaaaccttttgggttttaaggagtttattgctaatctgtaaaacagaaagagacaggagataagcatgacaaaatatagggaagaaatgacttttgcctaaacttccaaattgtgtacaattgaagcctctgctttatagctcttagcacacctctcaaataagaaggcagtactgggaaggctctgaacctgtggcagaaccactgatagctgtggagctattccaaggagtctgggaatcagggggattatcaagatcattgttagaataaattaatcttactgtatatatagcagaagttttcaagcatatgtaaatgctactaataaccaaataattacaccttgtttttctttaaactgtaactctcaagtatgtctctacataattttttgatggtagtgtctgcatgctcaaaaagcttgaaaacactactggagaagaaggtctcgggagtgtgatgaaatacgtttacatggcagcttcatcatttaattggtgaaagtgactatgtgtcttaaactctctgagcctcagtttgcacatccaaaagcaaggatataattccatgaacctttccacctcaagtccacaaggcagaatagcaagatgttaactgccactctgaggaccaccaaataaaaggacaatttattaggccacttgccagcatggacacaatcgactcttggcatttcttattatccacagaaaaattaaaagtataaatgtagaacaaaattatcgtgttttttttaatagtaacatgtaagatcaatctttgtctttaaaataccgtgtatctcattcttggaaagcgtcaaaatgaaaatggtatagtaagttttatctacaacttgaattaaaattattcttgaaatatgttctgaatggttagatgaaatggtaattaaatacaaatagagataatcatatactctctctccataaggctcccacctccttcaatgaagtctagttcacctaaaat

SEQ ID NO: 33095 - DNA, 375 bp, Homo sapiens
gttcgacgtgaaaggagcataaaccaggcttatcccaggtgaacctagaggtacggtgactctaattatagttcatcctttgcccctatctatcaggtggctggacacataattttctactgctactgctctggaaggagaaaaagaagagaataaaagatattggttaggcacccactattcctttccatttcattctcatttaattctgcccaaaagccaatgtacccaggcttttgggcaaaattaaatgagataaatgtacatgaaatcgctttgtaatctgcaatgtttcaaagctatgtttataaataatatcatcataatttagcacaaataagtacatgtgatggctagaaggaacccagtttggat

SEQ ID NO: 33096 - DNA, 419 bp, Homo sapiens
aacactatgctggaaaatcatgatcagaagaagcccagagactatactgagatttatgtcccataccaaaatgaaatctctggatcaactcttgattcctgatcaacacatacaccatcttcaccctacctgcaatggctctaggaatttatgcaactgcctacaaaataatatcaccaaatcattatgtctttgctataattagtttatcataagatgctccagtccatctgtaggattactagatgaccactcaatttgttcaatatgaaatgctttctctaaaggatatttaaggtctatctttattaagttcagaagagagtaaaccaagaaggattaagtgtagctgattgatgttttaaattcctggaaatttcccttggaaactccaaaattttacttctcagaacctaagt

SEQ ID NO: 33097 - DNA, 951 bp, Homo sapiens
gtgactctactcagaaaagcttagtaaagacttgttggttaaattggcacaaacaagacagagtagattatgagttctaaacttgggacatggctctgtctccactaggcaatgggtctgctctcagtggggcaaggaaggaatatttagagatttccccatccccatggctccagacttctaggagaaagattcaggtcaaaaagccttaaactgtgtgtcttcaactgatggtctatataagaggttcaaattttaagaaacgtttacgaatctctactatttaccaagccttgcactagccatgctagacacagtagctcaacacactcacaactctgtgacatcctttttctgatctgtaagatcagaatcaggcaaggtacttcatcccccctagacttactcctacaaatctggagtcacactgaccctgtgggattatggtcacacacatcagacgtgtgaccctgggactttcggttgaactcttggaacctcagctttccataacagatggttatgaggattaaatgaaagaccacattgatagaaaaagcttagcattgggcctgacatataatagatgtttaataaacacaagtttgttccttccctcccattccagatccggtgtttttgagaactgtgttacggtcaggtgatgataactggggcatgtctgctgccctgaataaataagagcttatctttctatctcgagtccactctaagtggtcagaacttgagtagcactaaacatatacctgttgactgactggctcatattgggtgttgtggaaggagcacatagcacctgggagcccagaggcctgggtggaagctctggctcctaccctagcttgttgaatggtcttgacctctctggccctcagatttctcatctgtaaaacaagcggaataaatcatacattctgattctaaaaaaaa

SEQ ID NO: 33098 - DNA, 199 bp, Homo sapiens
  misc_feature (9)..(9): n is a, c, g, or t
  misc_feature (33)..(33): n is a, c, g, or t
  misc_feature (49)..(49): n is a, c, g, or t
tgggggggnggtttgggttttttgggtcttggngggaaaaaaagggggnggaaagcacatagcacctgggagcccagaggcctgggtggaagctctggctcctaccctagcttgttgaatggtcttgacctctctggccctcagatttctcatctgtaaaacaagcggaataaatcatacattctgattctaaaaaaaa

SEQ ID NO: 33099 - DNA, 364 bp, Homo sapiens
ctaaagcaacttctgtcttataatcagccaagtctaggtggcaaattaaagaaaaatgtagctgtttctatgccaaggtttttagatgaagacgacataatctattgtggtggtgattaaactttttggttttgggaccctttactcttagaagcttttgaagtccctaaattgtttaggaccccaaagaacattgttttatgtacgatatctatccacacttactgtattaggaattaaagctaagtaatatttaacatacttaactcattaaaaataagccggtagcaaacctattacatgttaacataaaatgaaatgttttgaatcatgacttctccaaaacaaaaaaaaagaaattgca

SEQ ID NO: 33100 - DNA, 450 bp, Homo sapiens
ttttttttttgacatggagtctcgctcttgttgcccaggctgtagtacagtggcacgatctcggctcattgcagcctctgcctcccgggttcaagtgattctcctgcctcagccccccaagtagctgggactacaggtgcataccaccatgcccaactaattttgtatttttggtagagacggggtttctccatgttggtcaggctggtctcaaactcccgacctcaggtgatcggcccgccttggcctcccaaagtgctgggattacaggcgtgagtcaccgcgcccagcgaatattttccacatacctgtcaaaaggtttttccagacctagccttccataatgctttaagtgtttttgaaattgcacataatgctcatcattgtcaagccaacaacatttacttagcccctactaagccctggtcaccgtgcaacttgcctgggatt

SEQ ID NO: 33101 - DNA, 711 bp, Homo sapiens
agatgtacaaaactgaataagaacataacttagggtattttgtctgttaaactttagtcatgacatgttggggttggtttcgagatctttttccagcaccatggaaaacacaagggacagagagaaatgttggaattcgcagtgagatcattgtgttacctgttccgatttaattgctcctcaaattaactacatttttttctgtacatcttttgacctaagttgtttgtgaaggattaagtcgttgcctccctttccttggttcccaacagtatggcaggggcttctcacagagtccttttggaaactgtaaaactatcacccttgtattaaagcattggatattcttcattgcaaaatgccccataattttcaagttctacattaatttcaacaacatggtatatgaaatgaatttttttcatgaaaatattttcaaatatttaccaaaatgttaataattatttctctaggggacaaaatgtattttaaaaactacttgagaattttaatattccctaatctctgagcgaagatgaaggcttgggaagcatgaagtcatattcattcactgcttatttcaaaaccgtgtgaaagggatggtgaattcatccttcacataggcaaagtcacttaaaatgatgtattttcaaaattcactttaggaaagaattggcagtattccatattcagagtcaaaataaactgaga

SEQ ID NO: 33102 - DNA, 973 bp, Homo sapiens
gccatctctttactgaccagcttccttatgacttttggttgctgctaaatttgcttgtagccaccttggcttctcttgtagccctgtgtcagcctatggatttatctcttatagctaattggcttagtctttatctcctttggttctcataagattaattccaatgaacatttgttgtatacctaatgtatgtcagatcctatgattgatgtatagatagaatttccatgatatgttaaatatgtacctctttagtggcaggtgaggtgatttaattaaaagtattttttttcttatgatgaatgtttaaaaaatttttcttttcctctccattttattgtagtatttgataaattcaaaatatatgtaaaacatatgcaagctgtatagcagaacaataaaatgaacacctatgaattcaccactcaatccaataatcaaaatgaccagtattgaatgtgcttacttccagaggtgactaccatcctgaattgtgtatattatgccttgtttttaaaaataattttatcagatatgtatacatccctcaaaaatgtattgtatggtttctgttgtttttgagtggaaaaaatcatattgggtatagtttcctgggacttgcttatttcacttgatgttatgtttctgagttactaatattgggtatagatgtaagtcattaattttcactgctgtgtaatattccatgtgtgaatataacacagtgtatgcattcttctgttaatgggcattttggttgtttctaggttttgctgttatgaagttatatactttttggttcacagttgtaagaatttttctaattttcacactggggtatatgagccccagaggagtaatgaagatttgctaaggaatgtgtgggtacaaatgatgttaatgaatcagtttctagatcattacattccataggtactctttcctaaaaatggtaatgcctgaggcctcctgc

SEQ ID NO: 33103 - DNA, 474 bp, Homo sapiens
tctgtctcaaaaaaaaaaaaaaaaaaggaaagaaagaagtaagtccaaagcatgccaagatgaaaaagtgcttctctcatccaagttttcagtgctgaaaaaaaatgaagagggtttatgtaggcacacccacctttgaaatgacagccagtgcatttgtactgctgctgttagtgcttgtaatcttgaaggcaaagtagtttttgctattcaactttatatatatatacacacacacacattttttttctttttttttttgtttttaagagacagggtctctatctcctgacctcaggtgatctatttgaagtggttttcattgtgttgtaattgaagagctttggcaaccctcaaaatgctgattgaacaccttgtcctttcttgcaaatttcattccttacatgtaagagagaggtttgtaactacttatgcatgggtttactgcaggttgtactctactcaaaaaaaaag

SEQ ID NO: 33104 - DNA, 497 bp, Homo sapiens
gaccaggatttctggctgatgatttctttctgatttccttctcaaatttggatatggctccttgaggcctggcaagcagatgcttaatatttgttaaatgggaaagttttgtacaggggagtgatgtgaactggggtacagggaagaatagactgtagggcggagtgtagcgtggaagtagggaagttagagggctgttacgtaagtctagtggggaaatggtgggaacttaaactgtggtcatggtagagggagagagaagtggccagattcgcttatactgggtaaaacttaaactatcttagccaatatatctttaaaaaaaataggaacagagtaattacaatgaaaactctaattctgcaaagaggagaatggatgaaaaatagcacacagttattgttgatctgtagcataatttatgtcctgctaggcaggaatatggaagactccttgcctggcagtagaatgagttccttggcgaggtaactgggaaa

SEQ ID NO: 33105 - DNA, 1086 bp, Homo sapiens
gagtttgagaccagcctgaccaacatggtgaagccccgtctctactaaaattacaaagattagctgggcgtggtggcgggcacctgtggtcccggctactcaggaggctgaggcaggagaactgcttgaattgcttgaacctgggaggcgaaggttgtagtgagcagagatcgtgccactacactccagcctaggtgacagagactctgtctcaaaaaacaaacaaaaaaacaaaacaaaaaaaaacagttggacttgaatgtttttaactgggccccatcactcctttttgaatagtttgtgttgccagtcacaccctgtagggtttgtagcctgacttttcaagcagtgtggtggtagggagtccaaggaagttgagtggactgttttggacgtctttggaggaattggtgtggatgggtaatgacttagtatttcattgaaatgttcatttctctcgagttatttctggcagaggatagctctagtagtccccttctcttttccaaacacctttacctttgtcctaatgaaagtacttagttatctctttgggcagatgctatttctctagctaaattaacatgtcatcattcacagttggaaaactgtggctgtgctttttcatttttagagaaatgtttttaaaatacagaaaagaggctgggcgcggtggctcacacctgtaatcccagcactttgggaggccgaggtgggtgagtcacttgaggtcaggagtttaagaccagcctggccaacatggtgaaaccctgtctctactgaaaatacaaatatttagctgggcatggtggcgcgcacctgtaatcccagctacttgggaggctaagggaggagaatcgcttgaaagtgggaggcggaggttgcagtgagctgagattgcaccgctgcactccagcctgggcaacagagagagactccagctcagaaaaaataaaaataaaatacagaaaagaaagagaataactgtcacaaacccatatatccatcactgagaagtggcaattgtaaatattttgtaatttgctttaatttttttaaataaaagaaataaagtttattcacagc

SEQ ID NO: 33106 - DNA, 901 bp, Homo sapiens
caagcataaaatcagccttcaagggcttcttcatctctctccaggctgtccttagtcatcaggtctcacctggacaacagaggcccttatctgatggctgccctggtccagctgttaaccccttctaacctgtcctgcgaaaccaaaagaccaaactaaaaaaccttattaaacaaacacacagtgtcctcctactgaacaaaaggcaccagttctgatcccatggatacataaataggacactgactgggcagctcccatgcaggcacccttcccagggctgcacacatcctaggaggaattctcacaagccgctgcagggctgctaccctcatgatcttcattttatagatgaggaggttatgatgtgattctgggctgactcatgcccttataaatgcacaatgcctgaatttcgggctctcctgcctggtttcattcaatccaattgataattttctgccgggattgcagggctctctactaactgtgcttatgtccctcccacatctttgctgctgcacgcctccttgacaccaccttcccggcccctcctcttgtcatataacagtctttgcctttgaggcctactttctacaataagccctgctggtgcccctcctacatggccgggctccatgtccttcagtcagaccagtgtaagccctgaactgcgcacaaatcttctcacaggtgtcatttttcttctccaattagccatgtgctttcaaaggcagcaacgttatcttaacttttggtacgtcctatggcactcagcacggtgctgggcaaaaaaatgctccaaagtggtgactaagagaaaaagtattgaacacgttttcctacttctttctccttttatgtccccagctccttttgtgcatagtaataaattgccaac

SEQ ID NO: 33107 - DNA, 278 bp, Homo sapiens
tgagacagggtcttcctttgtcacccaggctggggtaccgtggcacaatcacatctcactgcagccttgacctcctggactccagtgacgtcctgcctgggcctctcaaagtgctggaattacaggtgtgagccaccatacctggtctcaacttgaaatttattttagctcataacttctactttagaagatgttttaaggccaggcgcgatggctcacacctataatcccagcactttgggaggctgaggcaggtggatcacctgaggtcaggaatt

SEQ ID NO: 33108 - DNA, 608 bp, Homo sapiens
gcaacatagtgagatctcatctcaacaaaaaatttaaaaatagctgggcatggtggcacatgcctatagtaccagttattgaggagactgaggcagaaggattgcttatttcctgtttatcttgtacttttacctgttggttgtagattgatttcaggtgacatttgaataaacccaataaagaagccaggaccctccacgtcttagaagccacgttaggctcattttgtgtgtatttctacactggtagacactgtaatgctctaagagtgctgcagctgtaagagaaatcacctggtctcatataatatagttccttaacctgataagctactactagtgtagtgttgtttatgcaccttaaaaaaaaaaaaaaaaaactgagcacgctttttatcttcattcaaagtgtttgcacctgtttttgtttggtttggtttggtttggtttttgacagtctcactgtctcccaggctggagtgctggagtgcaggagtggagtgagccaagatcgcaccattgcactccatcctgggcgacaaaaatgaaacaccgtctcaaaaaaaataaaaataataaaataaaatgcctttttgttgttgatgtaa

SEQ ID NO: 33109 - DNA, 402 bp, Homo sapiens
ccagtatttaatctgagcacttaaatcattttattaaagtgccaaaggcaatttgatatacctgttatccagcaaagaaacacaaggcaattattagtaaattttaacagattaatgcatttatttggtaggttttataatggctctatttcttgagtttgtatatatttgagaattatgttataaatatgttattatttcattgtctttgctatctatttgaaccaattttttagtaattgttaccgctcttttacttttttttttgttcctttgagactgagtctcgctccgtcgtccaggctggagtgcagtagcgcagtctcagcttactgcaacctccacctctcgggatcaagcagttctcctgcctcaccctcccgagtagctgggattacaggt

SEQ ID NO: 33110 - DNA, 1126 bp, Homo sapiens
aatttttgcatttttttgtagagacaaggcttcaccatgttgcccaagcggtctccaactcctgacctcaagtcatctgtccacctcggcctcctgaagtgctgggatcacagtcatgagccactgtgcccggcctcattgtcactgttaacacaggttttcatctccctattcctcattcttgacgttttctcaatcctcaaatctcatccatcatttctttgcaactgctgttctttgagatgtctgccaccaccataatacttacctttactactctcattccaggtaagtggaaaaggaaaacaattcttaaagtagctaagaagtactgttccagtcatgaatctggtatttaaaaaatccacctttcacagttgtttaagagccctctcttgaatgtcaataatccttaccacagctccctcctctgttctctctccctgttaagatgtcataattcactgataacaactaagctagccattgtgaactctttcccccactctcttcatctaatcctgtaaccaattccaaccagttctcctaactctctctccaagctgttccttcttgataattcacattatttttgcctatgcaaataccttttgaaagagtagtagcagctgagcacggtggctaacacttgtaatctcagcgctttgggaggccgaggcaggcaggagtttgcgaccagtttggccaacacggtgaaaccctgtctctactaaaaatacaaaaaattagctgggcgtggaggcaggagaatcgcttgaacctgggaggcagaggctgcagtgagccgagattgcgccactgcactccagcctcagtgagactccaactcaaaaaaaaaaaaaaaaaagagagtagcatgttacattttttccacaaaccattctccaacacttctgcatccctttaaaaagaaactcaaatgtggcaatctcccctcagtccaccagtcctccagtaaggtccattagttaccaatgactacccctgagccccactgtcaaatccattccctgacaatcagttttttcttttcaaaactctgtactcacttggcgtctgaaaaattattctactctaacttgtcccacttctgcttaggatcact

SEQ ID NO: 33111 - DNA, 471 bp, Homo sapiens
atactgtacatttcctcttacttaaaattctagacatacaaactaatcaaaattatagcaaggaaatgagtagttgcctgtgatctggggggaagacttgcaggccatgagttaacttgattatagtcacaagtatatgcatatgtcaaaacttaaccaaaccatatattttaaatatgtgcagttcctgaaacaaatgaaggctacatacttctcttccgtagtggaaagttagtaggataatatttaaaattgaaaagtcaagaagtaaaaatattaatgtacaattgaaggatataaagtttaaataccaaaagaatcagctaaaagttgacagcatttttttttttttttttttttttttgtagaaagcagaaactggaactgacataaaggatttctggctttcatttaaaaaaaaaaaagataaaagaagtttcctctttaaactatgtgtatatatcactttgg

SEQ ID NO: 33112 - DNA, 495 bp, Homo sapiens
agaaagtggaggcgtggaaagagaagctggtgaccacagtgcaaaatatgcagcagggagcagcccaatcccaagaggaactttgtcaacttcaggcaaagcttttaattgacagtgatgacgattctcagtgtcagatgaaccacagagatctgatccaaaaatatgaagggagtgaaactcaactcaaaaacctggggcaggagttagcacacacgcagcacagcatcaggcagctctgtgacggcaaagacagtctcttcccacagctggatattttaccccagactccccagtagaagcactttcttcacacaccgcagaatctcttcatgcaagtgagtctgctctatcaagtgagtcttctaaattgctccagcaagagatcgagaagctgagaaaatcactgcaggaaaaagatgcgaccattagatccctccaaggagacaatcaaagactgtatgattccattgctgccatctcagaacgagaaag

SEQ ID NO: 33113 - DNA, 412 bp, Homo sapiens
ctcactgcaacctccacctgccgggttcaagtaattctcctgcctcatcctcctgagtagctaggattataggagtgtaccaccaagcctggctaatttttgtatttttagtggagacggggtttcaccatgttgttcaggctggtctcgaactcctgatctcgtgaccccccgcctctgcctcccaaagtgctgggattacaggtgtgagccactgcacaggcccttcttaaaacaacattaaattagttttactcattcaatgctgttattagtttggggcattttagtcttccattggattcagaaataaacaaaataaagatttttagcacttttaaaccattgctttgctaatacctttatactttaacgatgattataatatattcactaataattttattcttaa

SEQ ID NO: 33114 - DNA, 2047 bp, Homo sapiens
gtggcactcacagcacaggcttgttatgggtctagcagcctctgtggcatctcctgtcacattgggaaaatgaagaattccaggacatgggcttggagggcgccggtggagctatttcttctctgtgctgccctgggctgtctcagtttgcctggctccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaaggtacaggtatgcctacttgctccagccctctcagttccatggggaaccgtgcaacttctctgacaaggaagtcgaagactgtgttaccaacagaccatgcagaagtcaagtgcgatgtgaaggctttgtgtgtgcacagacaggaaggtgtgtaaaccgcagacttctttgcaatggggacaatgactgtggagaccagtcagatgaagcaaactgtagaaggatttataaaaaatgtcagcatgaaatggaccaatactggggaattggcagtctggccagtgggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcacgccagctcagccctacaccagtttccacctggagttcatgcaagggcaaaaggcagtgccatgcaagctgtttaaaataaagatgttaccttgtaaaatgcaagttgatttaaataaatactgagttaaaggcttaagcatcttt

SEQ ID NO: 33115 - DNA, 469 bp, Homo sapiens
  misc_feature (21)..(21): n is a, c, g, or t
  misc_feature (31)..(31): n is a, c, g, or t
  misc_feature (59)..(59): n is a, c, g, or t
  misc_feature (100)..(100): n is a, c, g, or t
ctgagagtcaagagtagtctncctggtcctncaagaatgagtcctttctaaagatcacnttggctgattttcctgtggatccaaggcttagctgtaggtntcctatggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcacgccagctcagccctacaccagtttccacctggagttcatgcaagggcaaaaggcagtgccatgcaagctgtttaaaataaagatgttaccttgtaaaatgcaagttgatttaaataaatactgagttaaaggcttaagcatcttt

SEQ ID NO: 33116 - DNA, 1993 bp, Homo sapiens
gtggcactcacagcacaggcttgttatgggtctagcagcctctgtggcatctcctgtcacattgggaaaatgaagaattccaggacatgggcttggagggcgccggtggagctatttcttctctgtgctgccctgggctgtctcagtttgcctggctccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaaggtacaggtatgcctacttgctccagccctctcagttccatggggaaccgtgcaacttctctgacaaggaagtcgaagactgtgttaccaacagaccatgcagaagtcaagtgcgatgtgaaggctttgtgtgtgcacagacaggaaggtgtgtaaaccgcagacttctttgcaatggggacaatgactgtggagaccagtcagatgaagcaaactgtagaaggatttataaaaaatgtcagcatgaaatggaccaatactggggaattggcagtctggccagtgggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcacgccagctcagccctacaccagtttccacctggagttcatgcaagggcaaaaggcagtgccatgcaagctgtttaaaataaagatgttaccttgtaaaatgcaagttgatttaaataaatactgagttaaaggcttaagcatcttt

SEQ ID NO: 33117 - DNA, 1993 bp, Homo sapiens
gtggcactcacagcacaggcttgttatgggtctagcagcctctgtggcatctcctgtcacattgggaaaatgaagaattccaggacatgggcttggagggcgccggtggagctatttcttctctgtgctgccctgggctgtctcagtttgcctggctccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaaggtacaggtatgcctacttgctccagccctctcagttccatggggaaccgtgcaacttctctgacaaggaagtcgaagactgtgttaccaacagaccatgcagaagtcaagtgcgatgtgaaggctttgtgtgtgcacagacaggaaggtgtgtaaaccgcagacttctttgcaatggggacaatgactgtggagaccagtcagatgaagcaaactgtagaaggatttataagataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcacgccagctcagccctacaccagtttccacctggagttcatgcaagggcaaaaggcagtgccatgcaagctgtttaaaataaagatgttaccttgtaaaatgcaagttgatttaaataaatactgagttaaaggcttaagcatcttt

SEQ ID NO: 33118 - DNA, 1698 bp, Homo sapiens
gtttcttcatgctgctttctcagtacaggtatgcctacttgctccagccctctcagttccatggggaaccgtgcaacttctctgacaaggaagtcgaagactgtgttaccaacagaccatgcagaagtcaagtgcgatgtgaaggctttgtgtgtgcacagacaggaaggtgtgtaaaccgcagacttctttgcaatggggacaatgactgtggagaccagtcagatgaagcaaactgtagaaggatttataagataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcacgccagctcagccctacaccagtttccacctggagttcatgcaagggcaaaaggcagtgccatgcaagctgtttaaaataaagatgttaccttgtaaaatgcaagttgatttaaataaatactgagttaaaggcttaagcatcttt

SEQ ID NO: 33119 - DNA, 1752 bp, Homo sapiens
gtttcttcatgctgctttctcagtacaggtatgcctacttgctccagccctctcagttccatggggaaccgtgcaacttctctgacaaggaagtcgaagactgtgttaccaacagaccatgcagaagtcaagtgcgatgtgaaggctttgtgtgtgcacagacaggaaggtgtgtaaaccgcagacttctttgcaatggggacaatgactgtggagaccagtcagatgaagcaaactgtagaaggatttataaaaaatgtcagcatgaaatggaccaatactggggaattggcagtctggccagtgggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcacgccagctcagccctacaccagtttccacctggagttcatgcaagggcaaaaggcagtgccatgcaagctgtttaaaataaagatgttaccttgtaaaatgcaagttgatttaaataaatactgagttaaaggcttaagcatcttt

SEQ ID NO: 33120 - DNA, 1751 bp, Homo sapiens
agacaagtcagagataaaacagtgactgggtggaagggcattctgggcgcagggaacagtacctaccacagaaggagctgagtagactggagcaagagcaagcctcttcacatggctggggactagggcacgtggctgtggttaagggcggccataaatgaagctggaaagtggcttggaccaggtatcaagggccttgaaggctgtgcaaggagtttttgttttcgttcagtagggtctgacagtcaagattaagcaaccgcaaacttttaacctctttcgccatctctgtctctttcctcacaggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcacgccagctcagccctacaccagtttccacctggagttcatgcaagggcaaaaggcagtgccatgcaagctgtttaaaataaagatgttaccttgtaaaatgcaagttgatttaaataaatactgagttaaaggcttaagcatcttt

SEQ ID NO: 33121 - DNA, 2094 bp, Homo sapiens
gtggcactcacagcacaggcttgttatgggtctagcagcctctgtggcatctcctgtcacattgggaaaatgaagaattccaggacatgggcttggagggcgccggtggagctatttcttctctgtgctgccctgggctgtctcagtttgcctggctccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaaggtacaggtatgcctacttgctccagccctctcagttccatggggaaccgtgcaacttctctgacaaggaagtcgaagactgtgttaccaacagaccatgcagaagtcaagtgcgatgtgaaggctttgtgtgtgcacagacaggaaggtgtgtaaaccgcagacttctttgcaatggggacaatgactgtggagaccagtcagatgaagcaaactgtagaaggatttataaaaaatgtcagcatgaaatggaccaatactggggaattggcagtctggccagtgggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagagtaagttaattggaaaaggaactctggggaggtccagagaataattcaccagaagaagagcaaggagctggtgtggagtgtggggctggatactaggaaacctgagatccatcctgcttaaactcagcttggattgaaattccatctccatcatttaataactgatggattgattgttatgcatttcattatttttacaacacagagtgcttcatgttagagaaatatcaatgcgtggcttttgtaagccatctctttggatcattctggaatgcttaccctcttttcctgcttagtatactgctattcagccctcaaattccagcacgtatgccccctcctccataaaaaattcctctaatccccaaagaatgagctaattcctcctgctggctcccccgggactttgaacatgtatctattatagctctttgtgcattgtattttgggttgatgta

SEQ ID NO: 33122 - DNA, 703 bp, Homo sapiens
  misc_feature (703)..(703): n is a, c, g, or t
gtggcactcacagcacaggcttgttatgggtctagcagcctctgtggcatctcctgtcacattgggaaaatgaagaattccaggacatgggcttggagggcgccggtggagctatttcttctctgtgctgccctgggctgtctcagtttgcctggctccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaaggtacaggtatgcctacttgctccagccctctcagttccatggggaaccgtgcaacttctctgacaaggaagtcgaagactgtgttaccaacagaccatgcagaagtcaagtgcgatgtgaaggctttgtgtgtgcacagacaggaaggtgtgtaaaccgcagacttctttgcaatggggacaatgactgtggagaccagtcagatgaagcaaactgtagaaggatttataagataaatttgttcacaaacagttttgagggcccagttcttgatcacaggtattatgcaggtggatgctccccgcattacatcctgaacacgaggtttaggaagccctacaatgtggaaagctacacgccacagacccaaggctacgttcatattn

SEQ ID NO: 33123 - DNA, 370 bp, Homo sapiens
gattttaaaattggtggtgccattgaagaggtctacgtcagtctgggtgtgtctgtaggcaaatgcagaggtattctgaatgaaataaaaggtgagtgacaggggcttgtgacttccacacttataatgtttatcctcctagtgcctctggtgattacaacacctccctccctttttgagacaaatactatcccaacttctaggccaactatgtccttctgttttttatagttttaccatctaacatatcgctaactaacatgacttagtgttgcttatttttgaactttatatgaatggaatataatccttccagtcctgtgttttccattcaacataatgtttttgtgtataactatagttagttcac

SEQ ID NO: 33124 - DNA, 462 bp, Homo sapiens
agacaagtcagagataaaacagtgactgggtggaagggcattctgggcgcagggaacagtacctaccacagaaggagctgagtagactggagcaagagcaagcctcttcacatggctggggactagggcacgtggctgtggttaagggcggccataaatgaagctggaaagtggcttggaccaggtatcaagggccttgaaggctgtgcaaggagtttttgttttcgttcagtagggtctgacagtcaagattaagcaaccgcaaacttttaacctctttcgccatctctgtctctttcctcacaggataaatttgttcacaaacagttttgagggcccagttcttgatcacaggtattatgcaggtggatgctccccgcattacatcctgaacacgaggtttaggaagccctacaatgtggaaagctacacgccacaggtaagagacagccaggtagcagt

SEQ ID NO: 33125 - DNA, 336 bp, Homo sapiens
tcccacctacctgtctccctccagcttccatgtccctcctatctctctccatttccaggcaaccactgctcttctgtcattgtagattgatttacatttcctataattttatgtaaatggcatcatacaatatgtatttttttggtctggcttcttacattcagcctattaactttttgatttatctttattgttgcatgattgaataattcctttttaaaattgctaagtagtatatggatataccacaatttgttttatccattcactttttcatggacagtaggtagttttcagtttggggttcttctaaataaagctgccataaccatttgt

SEQ ID NO: 33126 - DNA, 703 bp, Homo sapiens
gtatgggaagaaatggtaatgccgcagaaaaatagacaaaggaatggccaatagatgtatgaaatctgtgtgacagattgtattttccacagatagtggcaacaatatcttccatcctacatgttcctcttacagtgtcactttgaccatccttacaattagaggtagagcctattcttccttcccttgaaactggtgggacttttgtggctattcaggccaataaagagtattgcagaagtgacattatgtgacttctgagtttagatcacaaacgatgacaaagcctgtgctttatttgctggaatactctctctttaagcctttagccaccatgtaagcagtatgactgttctgagggcactgtactgtaaggaagcccaaacagagggaccacagggttgggccctgggctacatgaagagaaagagatagacacctgcagctgctccagccaccatctggctgcatgtgcaggagagaccccaagccatttctgcccagccaacctcctaaaatccagactcctgaaactgtgtgagatagtaaatggactgctcattgtttaagcttctaagttggaggttgatttgttacatagtaaagaatggcaggaatagcatgcataacttcattagtcatcagggaaatgcaaattaaaaccaaaatgagattatcacttcacacctaccagaatgactga

SEQ ID NO: 33127 - DNA, 581 bp, Homo sapiens
gtccaatccatggattgcataaatgagcatgaaagccgtacttttcacccacattacatttatttacttttattttagaccccaaatgacaaaatttattttttcacaaatttttaaaaatgcttatgagttattgagatgagtgactcctactacttatacagcaagaagattacaaaggtacatttggcacagaaaatgccgccaattaattatacaaagaagttggaacaagctcagattatgtgaagaatgtgtacaagctcataaactgactttaattactatccaaactgtcccaaggggggaattagtgtatcaggtttggagcaagagcttggtaggatttttttctatttaaaaataagttacacttgctaaatatgtaacaatttaaagattactttcatatgtgctatcacatttacgcctcacaacaactcccgggtgcatgtattataagtgatattttagagactttcagaaactgagaattgctcaaggtcatatagcaagtgaatagcaaaagacatcaaattcaagtaatttgacttgaaggaggaaaatgtttttcatcagat

SEQ ID NO: 33128 - DNA, 592 bp, Homo sapiens
atctcttgaagccaaatgtttgagtccagtacaggcaacatggtgaaattctgtcaccataaaaaaataaataaaataaatatggctgggcatggtggttcacgcttgtaataccagcactttgggagtcggaggcaggtggataatgaggtcagggttcgagaccagcctggccaaaatggtgaaaccctttctctcctaaaaataataacaataaaaaatcagccaggcatggtgctgtgcgcctgtaatgccagctactcaaaaggttgaagcaagagaattgcttgagcctgggaggcggaggttgcattgagctaagatcatgccactacactctagcctgacccacagagcaagacactgtcttgaataaataaataaataaataaataaataaatttagccaggcctggaggtgcatgcctatagtcctaggtaattaagaggttgaggcaggaggactgctcaaacccaagaagttaaggttatagtgagctatgattatgccattgcacttcagactaagcaaaagagtaagattccatctcaaaaaattactaaaaaaagttctctaaattacattgtttaa

SEQ ID NO: 33129 - DNA, 1407 bp, Homo sapiens
aaatctttgtcttctttcccataaatagaacccaggatgagttatcctactaaagaaggaagtgatacagctggaaatgctcacaaaaattctgaaaatgagcctcctaatgactgtagtacagacatagagtctccatctgctgatcccaatatgatctatcaggtagaaaccaacccaataaacagggagccaggcacagcaacctcccaggaagatgttgttcctcaagcagcagaaaacagcgagctcgaaacagagatccaaaaagatcaacgagaagaagatctaaaagaagagcttcttctacttcagacccccattcccagaaaattggtctctcacaagcccttaaatgatagatcaagatcccactcagggaaagttgagatgaaagcaaacaatttccccataaatcacaaaactcgttttcgactttcaacttcatggagagtcccatttattaacagtcatgagataagaagtatgattctccatctgctatgtgatagatatttctctcaggctgcagggtgtcagaataccatgtgggtaaagcgaaaatatatagcatgtctttaccatccaaatagtttcacccatcacgagagagccataacatttagaaggccttcgagggtgcactactaccgtcccctcactgagagaatgacatcaggaaaattttgcaaatcaactgacactaaagggaaatgtagattccgtgctattgtgaggtctgtgctctttgtgtcacagatacaaattgaaagtatttttaatataaaaggttttgtggatatattgacatatatccataccatgaatgttatgatcacaaacaccaataatggttggaaatacttttgtcccatctgtggaaggctttttaacacttactctgaattaagacaacattcatgcagctcttctgggaattaaattaaattggggtaaattcattttaaaatataacttctaaaattcataatttgactactaaagtaagacaaaattgcatgaacataaattttagtattattagagggagtagcagaaaggaacacaaactaatagtacctctcagtaagaaatacctatggggagtgaggaaacatctgtttatactttgcttttacaagtacatcattgaaatatcagacctgtcatctatattgagtcagcatttgaaccaagtaaatgttttcactgtcttaacatctatttctgtagatgtaaatattgttaacataaaagaatccaagttaacaggatcctgactaagatagcaaacatatattggaaggccagacaaagttctaccaagtgtttccagagattctgctacatgtattatctgaaatgttctccatatattcaataaaaaccaatttgaagacatagaaa

SEQ ID NO: 33130 - DNA, 1605 bp, Homo sapiens
agaagaaaaggggtcaagaaggcaggaccccgtgaagcacacctttcctaaggattttgacgaatgagaatgaagataaactgtgagttgaaagtgaaagagaaagcataagggatcttaggtgcatctgacaagccttagatgacctccagcaacttcagttctcaccgaattactgcatttcagccttactgagaagcagccagtcatactatcctcaaattttaacccaggatgagttatcctactaaagaaggaagtgatacagctggaaatgctcacaaaaattctgaaaatgagcctcctaatgactgtagtacagacatagagtctccatctgctgatcccaatatgatctatcaggtagaaaccaacccaataaacagggagccaggcacagcaacctcccaggaagatgttgttcctcaagcagcagaaaacagcgagctcgaaacagagatccaaaaagatcaacgagaagaagatctaaaagaagagcttcttctacttcagacccccattcccagaaaattggtctctcacaagcccttaaatgatagatcaagatcccactcagggaaagttgagatgaaagcaaacaatttccccataaatcacaaaactcgttttcgactttcaacttcatggagagtcccatttattaacagtcatgagataagaagtatgattctccatctgctatgtgatagatatttctctcaggctgcagggtgtcagaataccatgtgggtaaagcgaaaatatatagcatgtctttaccatccaaatagtttcacccatcacgagagagccataacatttagaaggccttcgagggtgcactactaccgtcccctcactgagagaatgacatcaggaaaattttgcaaatcaactgacactaaagggaaatgtagattccgtgctattgtgaggtctgtgctctttgtgtcacagatacaaattgaaagtatttttaatataaaaggttttgtggatatattgacatatatccataccatgaatgttatgatcacaaacaccaataatggttggaaatacttttgtcccatctgtggaaggctttttaacacttactctgaattaagacaacattcatgcagctcttctgggaattaaattaaattggggtaaattcattttaaaatataacttctaaaattcataatttgactactaaagtaagacaaaattgcatgaacataaattttagtattattagagggagtagcagaaaggaacacaaactaatagtacctctcagtaagaaatacctatggggagtgaggaaacatctgtttatactttgcttttacaagtacatcattgaaatatcagacctgtcatctatattgagtcagcatttgaaccaagtaaatgttttcactgtcttaacatctatttctgtagatgtaaatattgttaacataaaagaatccaagttaacaggatcctgactaagatagcaaacatatattggaaggccagacaaagttctaccaagtgtttccagagattctgctacatgtattatctgaaatgttctccatatattcaataaaaaccaatttgaagacatagaaa

SEQ ID NO: 33131 - DNA, 404 bp, Homo sapiens
ggaggctgggaagcaggagaaacggggagtgactgctaatggacataggatttcttttgtgggggggatcaataaaaatattctggaattagacagtggtaatggttgaacatcttcatgaaatatactaaaaaccaataaattgtacaagttgaacaggtaaagttcatgcttcatgatatgtaaatttttttcacaacagaaaaaaaaaagagagtgagacagaaaagcaaatggcagccagatttggcctatgggctatagtttgccaaggcctaaactagacagacatccagctctttgagactatcctctagtgaggacctcacataacctaagtgtccctgtgatgtagcctggggggtgaggtagggaggagcaagaggaaggacatccgatacatc

SEQ ID NO: 33132 - DNA, 562 bp, Homo sapiens
aaagcactattaaagcacatctgtctcagcaggcccacccagccatcatcagaagtgggaggcaggaattctcgtggtatggtagaggaaggatttgaggtagacaggaggaacaagggaagggaaagtggaatcacattccctggaagcctcctatttgtgaggcaccagctgaaaccctgagagccaggtctctgagattccccatcctgccgttgattcttcctagtgggctaagtcccaactcccctactgtctggctgtaggatcctgaacaaattaatgaatcaacgaatctggagtccgaatattatgcacaccatacagtcataatgtgtcaaacaaaatgatgtgacccacactgataagggctctacagaagttagttatgccttaagacactgagggcagtaatctgtggatgagttggcctgaagggctttgagggaagggcatacggactgtcagaaagacctggaagatagcacctgttgccttaagagatatgcagagcttctggctaacacggtgaaaccccgtctcaccaaaaatccaaaaaaaa

SEQ ID NO: 33133 - DNA, 439 bp, Homo sapiens
ctctctgggctccagatgcctgtctcaaaaacagtgtggggccagagagggcagctccaggggtctctctcttcttgtccgagagcctggaaccagatgtcctctgctgactcatgggaatgttggaactgccagcacaggctatcccaggaccgtcccccgggccacagcagccagcgtcctccccacgccaggccctcagaccccatgttcccaatgctgggatatatcccaatgtgtgaggcagtgcttcttaatatttcctggtttcctggggttgacaccatgatgcagggtataggaagggttaaatgaggcgcaggtgtaacagaatcgggtgcacatgcaaaaactcagatgtgcaaataactgttccctattaactacaactaatcactttttttaattgccaattaaaatgaactcagtctttccatta

SEQ ID NO: 33134 - DNA, 376 bp, Homo sapiens
atggatgctgacccactctcatttgtcagcagaggaagtcggctcagagaacagtcacacagcaagtcgatggcagcgccaggccctgtcctgcagactccttgtccctctctcctctgaagcaaactctgggggctgagctcccaccccagccttgcttgctgtgtggcttggggcttgccaatgagcctctctgagtcctggtttcctggggttgacaccatgatgcagggtataggaagggttaaatgaggcgcaggtgtaacagaatcgggtgcacatgcaaaaactcagatgtgcaaataactgttccctattaactacaactaatcactttttttaattgccaattaaaatgaactcagtctttccatta

SEQ ID NO: 33135 - DNA, 345 bp, Homo sapiens
ggagaagtgggtaaattctcagtatggcaggttatgtcctgttggtatggttttctgaatgacacatgtcagagccataagaagaggtgttagtcaacacatatttattgatctcttaccatgttctgggccttggatatagagtgtgcttttccattttctgacaaaggccacatggcacatgatatgaaatgtaggaaggagattggacataggagaggacataaatgtcatcagatctaggaaaggaaaagatgagcgttgatcacatagcctgtgtcagggttgcagggaacttctagactaggatttatagaacccatggggcagacacaaaagtagtag

SEQ ID NO: 33136 - DNA, 950 bp, Homo sapiens
ggcacaaacgatgaatactgctaaagcaataacaataaaagaggcaacagacagtgggggaagccccagcaccaaccctcatttttctcataatatactctgttgtacaatgagacagagtgattccataggtaccagccagaaattacatgaaaaattgatcatgtttctttttctgggtgatatcagtgattgaggcccttgatttatgctggccaaactttttcagtgcagaatggaacccttcctaacttcagtctccgtggctcacacagactggccattaacagaagacacactgcatcataccatttagtcaggaccctacactaacagagggaactgcagcagagtcttaatagcaactccaatttgccaggaatctcaccacagatcagaaatttacagtggcggagaccttttaggaactttcagcatggatgctccctcaaggtgtgggtcagaatttgcggcgcaggaggtgaggtgaggtgaatagtttataatgatttttctatgccttttaacctttggaattaacatttggtcaagaaagccaattgaaggctaagtgtgtacttgacatgtgaaaaaatgaatgtgtcttctaggcgttggcttaggacactgctgagccctggctacagccaactcaggcttaactcattaaggtgattagccaacaatcaattctttaaaattagtaacataaaacaggccataccaggctcatggatataaaatttgggtatcaagttttgctccagagaaatgtcacaccctcaccggcaaaaagtctatagaggtagggagtgtcacaggtaaggttgagttaatgagacatcctctagctggcatgaatgtgtaaagtgcgctccatggtcatacatccagcaagtcaggatttcacagcaagcatagctttcactttaagctaagtgacatggaag

SEQ ID NO: 33137 - DNA, 613 bp, Homo sapiens
tttgccatgttgaccaggctggtcttgaacaccttacttcaggtgatctgccagcctcagtctcccaaagtgctgggattgcaggtgtgagccaccacatttttaggaataatactgacgtgatttggctgcatccccacctaaatctcatcttgaattgtagttcccataatccccatgtgtcccagaagggacccagtgggagctaatttaatcatgggggtgtttacccgcatgctggtcttgtgatagtgaattctcacaacaaggtctgatggttttataaggtcctttccccccttttgctcagcatttctccttgctgtccttctccatgtgaggaaggatgtgtttgcttccacttccaccatgactgtatgtttcctgaagcatcccaagccacgctgaactgtgagtcaattaaacctctttcctttataaattacccagtctcagctatgtctttattagcattgtaagaacgtattaatacaaatactcattgtgatagctaaattaacctattctcacaatttaatataataacccagtacttgcctcaaaactgaaatgacgtcttttgacaagttgcctaagaatcattgcttttgta

SEQ ID NO: 33138 - DNA, 475 bp, Homo sapiens
gctcacctcagcctcccaaagcctcagcctcttacagtgttgggattacaggcgtgagacactgtgacccgggacgattttcaatcacagttttttgttacgagtggaaaatgcgtatttataagaatgaagtagtacagacatgaatgtgtagaaatctgtataatcctgccatccaaggatggcacctgttaatgtgtatatcagggatgtccaatcttttggcctccctgtgccacactggaagaagaagaatcgccttgggccacgcataaaatacactaacactagcaatacctgatgagctaaaagaaaaaaaatcacaaaaaaacctcgtactgtttgaagaaagtttacagatttgcgttgggccgcaggttggacaagactgctatatgtatattctaggttttcccctataggtatacttatgtgaaaatgattattgtgataaattttgttttgagatgaagtc

SEQ ID NO: 33139 - DNA, 492 bp, Homo sapiens
gccgccgcctactactactaaattcgccgccggtcgacgggcttgctgtgagccagacactcagctcctccgctccccagagccccccatgaagcagaggctgagttcaacccactttacagaagaagctgagagaggggaagtgggtttcacaccgagaaatgccagagccagagctgcctctgggcacccaaccccaggtcctccctgctgtgtgggccgcaaggcatctgttctacagataagcacaggaagcctgcagaccccaggcttgtcccgggtcccacagctggaagtgacaggcgtggaggcaaatatgcaaacttctcagcactcggccagcggccttcccaattccatgagccccacatggaattgggaattgaaccaaatgtaataccggtctggattatgcttcatatcaactatttatatatttcagaagaaggtctgtttctatttgaatttggatatattcaaaacaaattgttt

SEQ ID NO: 33140 - DNA, 4444 bp, Homo sapiens
cgcccagctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtggcagtaggggagatagtgaaagtgaccaatggggaacatctcccagcagatctcatcagtctgtcctcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatggccatgtccctgaacctgaggattatggctgctctcctgatgaatggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttc

SEQ ID NO: 33141 - DNA, 1095 bp, Homo sapiens
tttttttttcctctgttcattttttttttttggccattttaattattttatactgggacgtgtaggtggcagtaggggagatagtgaaagtgaccaatggggaacatctcccagcagatctcatcagtctgtcctcaaggttagaaccactgagtcgtataggatgcgtgtatgtgggtcctcaccgtaaaccggagaacagttgcacccaaatatggttgagttctgtgtctcttcctttaaaacacaaactttttatactgcttggtgatggacatttcacagatgttttaaagggatttttgaatgctatgttgactgatgcttgtccttcagctgggcaaattgaactcctgttgttatcaataggagtctaagaggcatgacagtaaaggtagattttaatttcctgtgcaccattaatatatattcgtatttaataacatgcctaagtactaaggcttaatttattatctctccgggatattattttgaataatgttaagcttttcatgaaacagtcattgaaaattgattagattataaacatgtcttattcttgtattttaaatttttctgtaagttctgtaaaatccttccagcgattgtgactataatttgggctcatagggtttatagaggaccccctgcacaaagctggatgttgcacattttgtaccgcatgctttgggatcgacttttatcccacttgtatctagtgacaaagtgcacgttactgtgatcaatttcagctgtctactagtgactgtattgtgatatgcatcttgtttcatttttcacttactaatcaaaaagcctgctttgcctctcttgactagtttgtgttttagatgtcatcataatttgctgaaatatttatgatctagcatgattccttatctgagacttcttgctgccttttcacagcactattaagaattgcttcagtaactgctgtcctaagtgattgttgagaatgttctgaatttcgatgcttattttattaccccaacttcaaatagaacttagccatttgaacttcctaacttcctagccatttaaagacctagataagttactttatgcaaaaaaaaa

SEQ ID NO: 33142 - DNA, 772 bp, Homo sapiens
cgcccagctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcaggtaagaactaccaaagaatgccatgagaccagccagcagagcagagctggttaggtcaaaatgaaaatgcttgcaaagagctttcagtgcagtcagttaatatttgagagctccctgttggcagtgtgaataggctgtttccccatcttctctcccatagagaaatattcataagaatctggaaatagcgaggagcagaaagaataagcacccatcctctgccgatgctgcatagatattgaataatgaaagctgcttatgtgtaaatgcctctgtcctaaacctgttaatagagcgatgcgttactggttttggttagcaagttttaacattttagaagaggtctttgcaattctgcaccaagaattccttctggttatata

SEQ ID NO: 33143 - DNA, 1742 bp, Homo sapiens
  misc_feature (17)..(17): n is a, c, g, or t
  misc_feature (25)..(25): n is a, c, g, or t
ctactactactaaattngcggccgntcgacgttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttc

SEQ ID NO: 33144 - DNA, 3070 bp, Homo sapiens
cgcccagctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtggcagtaggggagatagtgaaagtgaccaatggggaacatctcccagcagatctcatcagtctgtcctcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatggccatgtccctgaacctgaggattatggctgctctcctgatgaatggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagaacactgacattcaagcaaataacaatttatacagtttatttacatagatttatcaagataccaggaatttaaagccactgccagcaataaatctgcttataaaaagttaattttataaaataagaatgtccaacttgtcgctttttaaatctaaattgacagacaataaaggaggttccccgaagccgtggtattttatgcgaaattatagggacgaaacataga

SEQ ID NO: 33145 - DNA, 2023 bp, Homo sapiens
cgcccagctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtggcagtaggggagatagtgaaagtgaccaatggggaacatctcccagcagatctcatcagtctgtcctcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatggccatgtccctgaacctgaggattatggctgctctcctgatgaatggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccaggtaaaacatctgctcagtgatttgtatggataagataaatttatatccatttttattttttcccttttgaataactagaaagtatgttttgtttttatttaactaaatttgtttagacaaaatattaaatcaaaatctttagtaca

SEQ ID NO: 33146 - DNA, 738 bp, Homo sapiens
gtgagagcatgcagaccaagagtaaggcaggcttccaaatgttcaggggtaaaaaaggtaagcgtaagaggagaaaactaccaaaaaagctagaggaggaacagttcgaaattccagtaccacaaacattgcaactgttgtagaagagattagcacttaaagatccaattaaaaaacacacacaattaggtagaaactcctatagataatatttttatggatataataaaaagttaataagggaatttgagagagtttcattagtatttgtgtactcggtctacataaaacttttttgactcagatttccttgctctacagttcagccacatagcgatatgggggagcatcgcactctgggtggtgttttttggaatctactcatctctgtggcctgccattccgatggcccctgatatgtcaggagaggtaatgtgcgctaataactcacaatccaacaaaaccttaaaaactggtattttttagcaaaccttaatcgtttagcataattttccatcttgttgatttatattaaaataggatttgaccatttaaaagctgtttttaaattccacagtttcgagtgattaatcttgagagaatattttaaacttgaacattttacttaaatctgacttaccttttcataaacataaccaagacaataaaatatggttgtcgggagcttgaatctcgttaagaatatccatatagaagatgccattttaaaattacacc

SEQ ID NO: 33147 - DNA, 457 bp, Homo sapiens
  misc_feature (401)..(401): n is a, c, g, or t
  misc_feature (419)..(419): n is a, c, g, or t
  misc_feature (432)..(432): n is a, c, g, or t
ttttttggtattacctaagaaatccatgtttattgtgcaaaatattagaaagcacatagcattaaataaagcaaattaaagtgctccataactccatcacccagaaataaccactctttgatatttttgctgtactatgtacagcaaattattccagatttttttcaaggcatattttttgagggcctaattttgtttttaaaaacttgctgggaattaaatagaaaattatagatgaatagaaaaacttgaatataatagttgatagactgcataggggacttccatttattcagttttaaatggtttatcaataggctttttcttctggggtggatctttccatggcttctccaaagctggtgacttccgacacagctgcagggaaaatcagagatatntgccatcactgaagcgtncttatttattttnaaatatattaaaacattttactatt

SEQ ID NO: 33148 - DNA, 3157 bp, Homo sapiens
taaccactcaaaatgcacattttctatgacattataaggccccaaccaaacaaatcagtcaggagtaaaagggaacatctcccatattgaagggacatctcccttcaataataccaaattggagccataaatgatacattttagcacaaacttttacccactgtatattaaaatacaatcatgtaaaagccgggcatggtggctcatgcctgtaatcccagcactttgagaggtcaaggcgggtggatcacttgaggtcggctacaaacttgtattatctgatacctactttgagcccaggccagaaaggataaagtaaagcatgagacgttgttagttcatttcaacagattggggagttgtgggttttagtctctgacgcttcattgttaccatgagagcctgcaagtttttcttttttctctcttttttttttttaacctctttgggtcatctgggaggacgtggtgctcttttagctctaacattttctggttgcaatgcgtttaggactgggatgcgaagtgagtgagtgagtgagccttctcaggaaaacactttctagaattttgtccgagtgtctgttgggaaacgcgcttacatcccgcagaaggcggtaaggacacagcgcacaactctgcattatacctgcgagttaaaaagccaagggttcgctcactcaaccttgaatgcgcgtcagaatcacctgggggaggttttacaaaatacccgtgctccacccaagacaatgaaatcagactccctgcgagcggggccgaacatcagcatttttgaggacgctccctgtggctgtgcatcggtgatctttaatcccctgctacttgttagaggagctggatgacacttcgtgggctcattctcataaataagctgctgaatggagtcctctcctcccaagagttgtcggtgttgcatcttttttgttgtttatttttttttaagccaacggacgaagacatccaacggtgctgcatcttaatggagggacatccagctaaagggaatcttggagacctccgcgggtttctagcagctcgcggcatgttggtttcccagggcaagaggccgccactgaaggtcagctctgtctttccagctgggcactggaggctctaagtctgttttcagcaggatcggaggaaggagacggggtggcgccaaggaaggaggagaaaaggcggccgagaaaaggaggagggcaaggggaagaggaagggcgagggaggagcctgaggagactcgcccggctcaaccccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaagagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgc

SEQ ID NO: 33149 - DNA, 3321 bp, Homo sapiens
taaccactcaaaatgcacattttctatgacattataaggccccaaccaaacaaatcagtcaggagtaaaagggaacatctcccatattgaagggacatctcccttcaataataccaaattggagccataaatgatacattttagcacaaacttttacccactgtatattaaaatacaatcatgtaaaagccgggcatggtggctcatgcctgtaatcccagcactttgagaggtcaaggcgggtggatcacttgaggtcggctacaaacttgtattatctgatacctactttgagcccaggccagaaaggataaagtaaagcatgagacgttgttagttcatttcaacagattggggagttgtgggttttagtctctgacgcttcattgttaccatgagagcctgcaagtttttcttttttctctcttttttttttttaacctctttgggtcatctgggaggacgtggtgctcttttagctctaacattttctggttgcaatgcgtttaggactgggatgcgaagtgagtgagtgagtgagccttctcaggaaaacactttctagaattttgtccgagtgtctgttgggaaacgcgcttacatcccgcagaaggcggtaaggacacagcgcacaactctgcattatacctgcgagttaaaaagccaagggttcgctcactcaaccttgaatgcgcgtcagaatcacctgggggaggttttacaaaatacccgtgctccacccaagacaatgaaatcagactccctgcgagcggggccgaacatcagcatttttgaggacgctccctgtggctgtgcatcggtgatctttaatcccctgctacttgttagaggagctggatgacacttcgtgggctcattctcataaataagctgctgaatggagtcctctcctcccaagagttgtcggtgttgcatcttttttgttgtttatttttttttaagccaacggacgaagacatccaacggtgctgcatcttaatggagggacatccagctaaagggaatcttggagacctccgcgggtttctagcagctcgcggcatgttggtttcccagggcaagaggccgccactgaaggtcagctctgtctttccagctgggcactggaggctctaagtctgttttcagcaggatcggaggaaggagacggggtggcgccaaggaaggaggagaaaaggcggccgagaaaaggaggagggcaaggggaagaggaagggcgagggaggagcctgaggagactcgcccggctcaaccccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaaggctttttcttctggggtggatctttccatggcttctccaaagctggtgacttccgacacagctgcagggaaaatcagagatattctccatgacctagaagaaattcaggaaaaattacaagaaagcgtcacctggaaagaggctcctgaagcacaaatgcagggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgc

SEQ ID NO: 33150 - DNA, 3622 bp, Homo sapiens
taaccactcaaaatgcacattttctatgacattataaggccccaaccaaacaaatcagtcaggagtaaaagggaacatctcccatattgaagggacatctcccttcaataataccaaattggagccataaatgatacattttagcacaaacttttacccactgtatattaaaatacaatcatgtaaaagccgggcatggtggctcatgcctgtaatcccagcactttgagaggtcaaggcgggtggatcacttgaggtcggctacaaacttgtattatctgatacctactttgagcccaggccagaaaggataaagtaaagcatgagacgttgttagttcatttcaacagattggggagttgtgggttttagtctctgacgcttcattgttaccatgagagcctgcaagtttttcttttttctctcttttttttttttaacctctttgggtcatctgggaggacgtggtgctcttttagctctaacattttctggttgcaatgcgtttaggactgggatgcgaagtgagtgagtgagtgagccttctcaggaaaacactttctagaattttgtccgagtgtctgttgggaaacgcgcttacatcccgcagaaggcggtaaggacacagcgcacaactctgcattatacctgcgagttaaaaagccaagggttcgctcactcaaccttgaatgcgcgtcagaatcacctgggggaggttttacaaaatacccgtgctccacccaagacaatgaaatcagactccctgcgagcggggccgaacatcagcatttttgaggacgctccctgtggctgtgcatcggtgatctttaatcccctgctacttgttagaggagctggatgacacttcgtgggctcattctcataaataagctgctgaatggagtcctctcctcccaagagttgtcggtgttgcatcttttttgttgtttatttttttttaagccaacggacgaagacatccaacggtgctgcatcttaatggagggacatccagctaaagggaatcttggagacctccgcgggtttctagcagctcgcggcatgttggtttcccagggcaagaggccgccactgaaggtcagctctgtctttccagctgggcactggaggctctaagtctgttttcagcaggatcggaggaaggagacggggtggcgccaaggaaggaggagaaaaggcggccgagaaaaggaggagggcaaggggaagaggaagggcgagggaggagcctgaggagactcgcccggctcaaccccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtagggaggccgggcccgcagctcccctggctcccccgggctgcccgccgcctgaccctttcccatgtggctcgaacccctttcctcagccgttctacttttacgttccttttctcagtctaaaagtcgagttccgctcttcggaggcactttggaaagttcataaaagtatgaagaagtagaaaaaaacaaattccccatcttccgaaagcttgtcaacttagctgttacacagcttggcatatttcaacttcttcccaatcgatcttcggtctctttctctgaaacttgtaaaattgtggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaaggctttttcttctggggtggatctttccatggcttctccaaagctggtgacttccgacacagctgcagggaaaatcagagatattctccatgacctagaagaaattcaggaaaaattacaagaaagcgtcacctggaaagaggctcctgaagcacaaatgcagggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgc

SEQ ID NO: 33151 - DNA, 2384 bp, Homo sapiens
catggctggatcaggcctggatttaatcggacgaggcccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtagggaggccgggcccgcagctcccctggctcccccgggctgcccgccgcctgaccctttcccatgtggctcgaacccctttcctcagccgttctacttttacgttccttttctcagtctaaaagtcgagttccgctcttcggaggcactttggaaagttcataaaagtatgaagaagtagaaaaaaacaaattccccatcttccgaaagcttgtcaacttagctgttacacagcttggcatatttcaacttcttcccaatcgatcttcggtctctttctctgaaacttgtaaaattgtggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaaggctttttcttctggggtggatctttccatggcttctccaaagctggtgacttccgacacagctgcagggaaaatcagagatattctccatgacctagaagaaattcaggaaaaattacaagaaagcgtcacctggaaagaggctcctgaagcacaaatgcagggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgc

SEQ ID NO: 33152 - DNA, 3013 bp, Homo sapiens
taaccactcaaaatgcacattttctatgacattataaggccccaaccaaacaaatcagtcaggagtaaaagggaacatctcccatattgaagggacatctcccttcaataataccaaattggagccataaatgatacattttagcacaaacttttacccactgtatattaaaatacaatcatgtaaaagccgggcatggtggctcatgcctgtaatcccagcactttgagaggtcaaggcgggtggatcacttgaggtcggctacaaacttgtattatctgatacctactttgagcccaggccagaaaggataaagtaaagcatgagacgttgttagttcatttcaacagattggggagttgtgggttttagtctctgacgcttcattgttaccatgagagcctgcaagtttttcttttttctctcttttttttttttaacctctttgggtcatctgggaggacgtggtgctcttttagctctaacattttctggttgcaatgcgtttaggactgggatgcgaagtgagtgagtgagtgagccttctcaggaaaacactttctagaattttgtccgagtgtctgttgggaaacgcgcttacatcccgcagaaggcggtaaggacacagcgcacaactctgcattatacctgcgagttaaaaagccaagggttcgctcactcaaccttgaatgcgcgtcagaatcacctgggggaggttttacaaaatacccgtgctccacccaagacaatgaaatcagactccctgcgagcggggccgaacatcagcatttttgaggacgctccctgtggctgtgcatcggtgatctttaatcccctgctacttgttagaggagctggatgacacttcgtgggctcattctcataaataagctgctgaatggagtcctctcctcccaagagttgtcggtgttgcatcttttttgttgtttatttttttttaagccaacggacgaagacatccaacggtgctgcatcttaatggagggacatccagctaaagggaatcttggagacctccgcgggtttctagcagctcgcggcatgttggtttcccagggcaagaggccgccactgaaggtcagctctgtctttccagctgggcactggaggctctaagtctgttttcagcaggatcggaggaaggagacggggtggcgccaaggaaggaggagaaaaggcggccgagaaaaggaggagggcaaggggaagaggaagggcgagggaggagcctgaggagactcgcccggctcaaccccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgc

SEQ ID NO: 33153 - DNA, 3356 bp, Homo sapiens
taaccactcaaaatgcacattttctatgacattataaggccccaaccaaacaaatcagtcaggagtaaaagggaacatctcccatattgaagggacatctcccttcaataataccaaattggagccataaatgatacattttagcacaaacttttacccactgtatattaaaatacaatcatgtaaaagccgggcatggtggctcatgcctgtaatcccagcactttgagaggtcaaggcgggtggatcacttgaggtcggctacaaacttgtattatctgatacctactttgagcccaggccagaaaggataaagtaaagcatgagacgttgttagttcatttcaacagattggggagttgtgggttttagtctctgacgcttcattgttaccatgagagcctgcaagtttttcttttttctctcttttttttttttaacctctttgggtcatctgggaggacgtggtgctcttttagctctaacattttctggttgcaatgcgtttaggactgggatgcgaagtgagtgagtgagtgagccttctcaggaaaacactttctagaattttgtccgagtgtctgttgggaaacgcgcttacatcccgcagaaggcggtaaggacacagcgcacaactctgcattatacctgcgagttaaaaagccaagggttcgctcactcaaccttgaatgcgcgtcagaatcacctgggggaggttttacaaaatacccgtgctccacccaagacaatgaaatcagactccctgcgagcggggccgaacatcagcatttttgaggacgctccctgtggctgtgcatcggtgatctttaatcccctgctacttgttagaggagctggatgacacttcgtgggctcattctcataaataagctgctgaatggagtcctctcctcccaagagttgtcggtgttgcatcttttttgttgtttatttttttttaagccaacggacgaagacatccaacggtgctgcatcttaatggagggacatccagctaaagggaatcttggagacctccgcgggtttctagcagctcgcggcatgttggtttcccagggcaagaggccgccactgaaggtcagctctgtctttccagctgggcactggaggctctaagtctgttttcagcaggatcggaggaaggagacggggtggcgccaaggaaggaggagaaaaggcggccgagaaaaggaggagggcaaggggaagaggaagggcgagggaggagcctgaggagactcgcccggctcaaccccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaaggctttttcttctggggtggatctttccatggcttctccaaagctggtgacttccgacacagctgcagggaaaatcagagatattctccatgacctagaagaaattcaggaaaaattacaagaaagcgtcacctggaaagaggctcctgaagcacaaatgcagggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgcccacaacaaaccacgacacaaccacaaccaaacac

SEQ ID NO: 33154 - DNA, 1816 bp, Homo sapiens
ttttttggtattacctaagaaatccatgtttattgtgcaaaatattagaaagcacatagcattaaataaagcaaattaaagtgctccataactccatcacccagaaataaccactctttgatatttttgctgtactatgtacagcaaattattccagatttttttcaaggcatattttttgagggcctaattttgtttttaaaaacttgctgggaattaaatagaaaattatagatgaatagaaaaacttgaatataatagttgatagactgcataggggacttccatttattcagttttaaatggtttatcaataggctttttcttctggggtggatctttccatggcttctccaaagctggtgacttccgacacagctgcagggaaaatcagagatattctccatgacctagaagaaattcaggaaaaattacaagaaagcgtcacctggaaagaggctcctgaagcacaaatgcagggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgc

SEQ ID NO: 33155 - DNA, 1370 bp, Homo sapiens
ttgagcatctctgctgtggcaccaactacagccaactgcctgttcccaaacctgctgaggtatttctgcatctgtgctgtggccaccaactatagccaactgcctcttcctaaacctgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgc

SEQ ID NO: 33156 - DNA, 903 bp, Homo sapiens
  misc_feature (2)..(2): n is a, c, g, or t
  misc_feature (5)..(5): n is a, c, g, or t
  misc_feature (49)..(49): n is a, c, g, or t
cnggnacttctgtgcttgttctcttgtaggagaggttagttttgttttnctatttcacgtgttcatattctttgagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgc

SEQ ID NO: 33157 - DNA, 2289 bp, Homo sapiens
taaccactcaaaatgcacattttctatgacattataaggccccaaccaaacaaatcagtcaggagtaaaagggaacatctcccatattgaagggacatctcccttcaataataccaaattggagccataaatgatacattttagcacaaacttttacccactgtatattaaaatacaatcatgtaaaagccgggcatggtggctcatgcctgtaatcccagcactttgagaggtcaaggcgggtggatcacttgaggtcggctacaaacttgtattatctgatacctactttgagcccaggccagaaaggataaagtaaagcatgagacgttgttagttcatttcaacagattggggagttgtgggttttagtctctgacgcttcattgttaccatgagagcctgcaagtttttcttttttctctcttttttttttttaacctctttgggtcatctgggaggacgtggtgctcttttagctctaacattttctggttgcaatgcgtttaggactgggatgcgaagtgagtgagtgagtgagccttctcaggaaaacactttctagaattttgtccgagtgtctgttgggaaacgcgcttacatcccgcagaaggcggtaaggacacagcgcacaactctgcattatacctgcgagttaaaaagccaagggttcgctcactcaaccttgaatgcgcgtcagaatcacctgggggaggttttacaaaatacccgtgctccacccaagacaatgaaatcagactccctgcgagcggggccgaacatcagcatttttgaggacgctccctgtggctgtgcatcggtgatctttaatcccctgctacttgttagaggagctggatgacacttcgtgggctcattctcataaataagctgctgaatggagtcctctcctcccaagagttgtcggtgttgcatcttttttgttgtttatttttttttaagccaacggacgaagacatccaacggtgctgcatcttaatggagggacatccagctaaagggaatcttggagacctccgcgggtttctagcagctcgcggcatgttggtttcccagggcaagaggccgccactgaaggtcagctctgtctttccagctgggcactggaggctctaagtctgttttcagcaggatcggaggaaggagacggggtggcgccaaggaaggaggagaaaaggcggccgagaaaaggaggagggcaaggggaagaggaagggcgagggaggagcctgaggagactcgcccggctcaaccccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtagggaggccgggcccgcagctcccctggctcccccgggctgcccgccgcctgaccctttcccatgtggctcgaacccctttcctcagccgttctacttttacgttccttttctcagtctaaaagtcgagttccgctcttcggaggcactttggaaagttcataaaagtatgaagaagtagaaaaaaacaaattccccatcttccgaaagcttgtcaacttagctgttacacagcttggcatatttcaacttcttcccaatcgatcttcggtctctttctctgaaacttgtaaaattgtggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaaggtaggctccactgggagaggaaaggatgtggaagggaatagggctagggattgctttcaactggaacaacatgaacatatttgaacctgaaggatacaataagtctcaatcttttattgttctctttactaccagacatggatgattggacatttggaatgcttga

SEQ ID NO: 33158 - DNA, 363 bp, Homo sapiens
cccggcgccgcccggaactgcagcgggtagggaggccgggcccgcagctcccctggctcccccgggctgcccgccgcctgaccctttcccatgtggctcgaacccctttcctcagccgttctacttttacgttccttttctcagtctaaaagtcgagttccgctcttcggaggcactttggaaagttcataaaagtatgaagaagtagaaaaaaacaaattccccatcttccgaaagcttgtcaacttagctgttacacagcttggcatatttcaacttcttcccaatcgatcttcggtctctttctctgaaacttgtaaaattgtggtaagatctatataacattaaaactggccattttaa

SEQ ID NO: 33159 - DNA, 389 bp, Homo sapiens
gcctcgacttcccaggctcaagtgatcctcccagctctcagcctccaaagtagctggcactacaagtgtacacccccacacaaggctaagttttgtattttttgtagagacagggtttcaacatattatccaggctggtgtcgaattcctgggctccagggatccacaccgcctcagcctcccaaagtgctgggattacaggccccttgttcagccactgcacctggccccttattttgtttttgttttctaatatactttgatgtaatcagcttgagaaagcaacacaatttcaaatcctatcttctagatgcaagcagtgttaaatttgttaataaatttgcttttcacacctttctttaaataaaaggtatatctctctttcttgt

SEQ ID NO: 33160 - DNA, 1529 bp, Homo sapiens
cacaaaaaccctgactatcacctgatagattgcttgtgctgcctgataattactcgcacttttcccaggctagtgcaaatcttcaggggccgtccaggactacagagctgtttcaccctaccttggcttcaatctcttcccccatgctcgaaggtgcggagctgtacttcaacgtggaccatggctacctggagggcctggttcgaggatgcaaggccagcctcctgacccagcaagactatatcaacctggtccagtgtgagaccctagaagacctgaaaattcatctccagactactgattatggtaactttttggctaatcacacaaatcctcttactgtttccaaaattgacactgagatgaggaaaagactatgtggagaatttgagtatttccggaatcattccctggagcccctcagcacatttctcacctatatgacgtgcagttatatgatagacaatgtgattctgctgatgaatggtgcattgcagaaaaaatctgtgaaagaaattctggggaagtgccaccccttgggccgtttcacagaaatggaagctgtcaacattgcagagacaccttcagatctctttaatgccattctgatcgaaacgccattagctccattcttccaagactgcatgtctgaaaatgctctagatgaactgaatattgaattgctacgcaataaactatacaagtcttaccttgaggcattctataaattctgtaagaatcatggtgatgtcacagcagaagttatgtgtcccattcttgagtttgaggccgacagacgtgcttttatcatcactcttaactcctttggcactgaattgagcaaagaagaccgagagaccctctatccaaccttcggcaaactctatcctgaggggttgcggctgttggctcaagcagaagactttgaccagatgaagaacgtagcggatcattacggagtatacaaacctttatttgaagctgtaggtggcagtgggggaaagacattggaggacgtgttttacgagcgtgaggtacaaatgaatgtgctggcattcaacagacagttccactacggtgtgttttatgcatatgtaaagctgaaggaacaggaaattagaaatattgtgtggatagcagaatgtatttcacagaggcatcgaactaaaatcaacagttacattccaattttataacccaagtaaggttctcaaatgtagaaaattataaatgttaaaaggaagttattgaagaaaataaaagaaattatgttatattatctagactacacaaaagtaagccacactatatcttcatgagttgcaaatccatggaaacacagtaaaccagccctgaaacaaagcatttccttgttttcagtggtattagatcttgtttccacatgtctgtctcattcttcactgggccttacaggttagttttaattaactctatggtatttttcttattcttgtttgatcatgttaaaaattggacctaataaaagtattttattcttgcttttccat

SEQ ID NO: 33161 - DNA, 1761 bp, Homo sapiens
ttaaaatcacagataaaataagttcctatggtgaggaatggaggcctccagctgacagagagcaaagaactgaggcctgcgacaactataggcgtgatcctgggaaccgattctcaacctcatctgagccttgagacgactgctgctctggccgacagcctgacggcaacctcctgagacagctctgagaggagattttccaggttcaagtcccgagacgaggtttcaccgtgctggccaagctggtctccacctcaggtgatctgccccgctaagcctccgcaagtgctgggattacaggctagtgcaaatcttcaggggccgtccaggactacagagctgtttcaccctaccttggcttcaatctcttcccccatgctcgaaggtgcggagctgtacttcaacgtggaccatggctacctggagggcctggttcgaggatgcaaggccagcctcctgacccagcaagactatatcaacctggtccagtgtgagaccctagaagacctgaaaattcatctccagactactgattatggtaactttttggctaatcacacaaatcctcttactgtttccaaaattgacactgagatgaggaaaagactatgtggagaatttgagtatttccggaatcattccctggagcccctcagcacatttctcacctatatgacgtgcagttatatgatagacaatgtgattctgctgatgaatggtgcattgcagaaaaaatctgtgaaagaaattctggggaagtgccaccccttgggccgtttcacagaaatggaagctgtcaacattgcagagacaccttcagatctctttaatgccattctgatcgaaacgccattagctccattcttccaagactgcatgtctgaaaatgctctagatgaactgaatattgaattgctacgcaataaactatacaagtcttaccttgaggcattctataaattctgtaagaatcatggtgatgtcacagcagaagttatgtgtcccattcttgagtttgaggccgacagacgtgcttttatcatcactcttaactcctttggcactgaattgagcaaagaagaccgagagaccctctatccaaccttcggcaaactctatcctgaggggttgcggctgttggctcaagcagaagactttgaccagatgaagaacgtagcggatcattacggagtatacaaacctttatttgaagctgtaggtggcagtgggggaaagacattggaggacgtgttttacgagcgtgaggtacaaatgaatgtgctggcattcaacagacagttccactacggtgtgttttatgcatatgtaaagctgaaggaacaggaaattagaaatattgtgtggatagcagaatgtatttcacagaggcatcgaactaaaatcaacagttacattccaattttataacccaagtaaggttctcaaatgtagaaaattataaatgttaaaaggaagttattgaagaaaataaaagaaattatgttatattatctagactacacaaaagtaagccacactatatcttcatgagttgcaaatccatggaaacacagtaaaccagccctgaaacaaagcatttccttgttttcagtggtattagatcttgtttccacatgtctgtctcattcttcactgggccttacaggttagttttaattaactctatggtatttttcttattcttgtttgatcatgttaaaaattggacctaataaaagtattttattcttgcttttccat

SEQ ID NO: 33162 - DNA, 646 bp, Homo sapiens
ttaaaatcacagataaaataagttcctatggtgaggaatggaggcctccagctgacagagagcaaagaactgaggcctgcgacaactataggcgtgatcctgggaaccgattctcaacctcatctgagccttgagacgactgctgctctggccgacagcctgacggcaacctcctgagacagctctgagaggagattttccaggttcaagtcccgagacgaggtttcaccgtgctggccaagctggtctccacctcaggtgatctgccccgctaagcctccgcaagtgctgggattacaggctagtgcaaatcttcaggggccgtccaggactacagagctgtttcaccctaccttggcttcaatctcttcccccatgctcgaaggtgcggagctgtacttcaacgtggaccatggctacctggagggcctggttcgaggatgcaaggccagcctcctgacccagcaagactatatcaacctggccccttattttgtttttgttttctaatatactttgatgtaatcagcttgagaaagcaacacaatttcaaatcctatcttctagatgcaagcagtgttaaatttgttaataaatttgcttttcacacctttctttaaataaaaggtatatctctctttcttgt

SEQ ID NO: 33163 - DNA, 299 bp, Homo sapiens
ggtggggcttctggtatggggctgagcaagtgccagtggcctctggcctgggagccaaaggacagaggaagatctgaggatccgacaagacctggggccaatcatcaagggtcagggaggctgagaggtggaataagggaagagctggaaggaaagggaggccgggccatcttctagcaaagctgtcagcccagagaacactgtcttggggtgcagcacttgagggagaaatctgaggtgccatttctaagcccaacaggcaccatgccaagcattttgaaggggtgtaaaggacagtt

SEQ ID NO: 33164 - DNA, 434 bp, Homo sapiens
cttggctaatttttttgttgttgtttcaaatatttgtagagacagggtcttgctatgttgaccaagctggtatggtactctgatcctccagcctcagcctcccaaagcaatgagattataggaatgagccaccgcacccagccaaaactaacagttccaggggagcgtcctgatttttagactggattcttctgggctgctgggaagatcctggtgagtcataatgagagaggctgggctgatagtgaagtttgcctcatgtcctcattctcctcaatttttctgagtccctctccttgccttccttttccactcatctatcacagacatcaaatccagaggtattccaaagcaggcagccttctactagctcatcctacaaattttacctctgaacatgaacataaaaatcttcagactctatctcaaaaaaa

SEQ ID NO: 33165 - DNA, 578 bp, Homo sapiens
gtttatatggttgattttaatcaataatactgagagaacttaacacgtttaatataaatcctcacaacacccctgtgaggtaagtattgcttacacccactttacggatgggaaatcagaaagagcaagaagtaacaatctcaagagttataaataaaaaaattttttgttttcttataaggcagactgtgctgagttctgatgatacgctaataagaacaaatactaaaacagtctctatttttctccagaaaacaactgcgtgagatttcaaaagaaggaaaaattttaagctgactcaaggggaaaatgtttagtatctgcctgatacacacgaaagtgcatatgacatttccagtttcaagcttggtaatcattatgcaaactgcactatactattaggatactggctaacagtatagctccattttgtggagatgtagtcaaaaaataaaggttttagctggaagaacttttttttttttgagatggagtctcgctctgtcacccaggctggagcgcagtggcgcgatctccgcccaccgcaacctccgcctggcgacacagcacgactgtct

SEQ ID NO: 33166 - DNA, 1246 bp, Homo sapiens
atgcatgagaagcagtagatgtgtctctcattctttcttctttcattgcctgctaagtactgtttgtataccagtagcatgggtcagagtgggaggttgtcaacagaagagtccagcatgtatccatgatggactctcgatcaactttatatgattaactcatataaaacagccctgtatggaagctgaggctgcctcttcctagccacaggatattgacctactttccccttcttatctgcttgcaaaatatttgttgtacttagtgtgttctccctgtcacaacgaatgtttgtctctctctttcatatgaactgaaggctaaagtgctagttaaatcagtggaaaaagcaatggagaagaaaagttgctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccactgtgttctatcagctgctctctggtggcctctgaagagctcctcaataaacttagcttgagaggggattcagcagggtattactaacctgagtccgatttccggccaaagtgcatggagtggattgatggccgcaattttagaaccgtgcggaaatgccatgcagatggtggcctactgcatcaggagctgaatctggctggggtgtgcgcaaggtaactgcggaacttgggttcagccaattctgtga

SEQ ID NO: 33167 - DNA, 1105 bp, Homo sapiens
atgcatgagaagcagtagatgtgtctctcattctttcttctttcattgcctgctaagtactgtttgtataccagtagcatgggtcagagtgggaggttgtcaacagaagagtccagcatgtatccatgatggactctcgatcaactttatatgattaactcatataaaacagccctgtatggaagctgaggctgcctcttcctagccacaggatattgacctactttccccttcttatctgcttgcaaaatatttgttgtacttagtgtgttctccctgtcacaacgaatgtttgtctctctctttcatatgaactgaaggctaaagtgctagttaaatcagtggaaaaagcaatggagaagaaaagttgctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactgtgagtatttttctccagtccttgtaagaagttcagaatactaaaacatatatttatagtagaatagtttagatacttgttgtctttgaggccataagaatatgttccttgctttatatttagactttaagctttgcatttcagattgttttataatagaatgt

SEQ ID NO: 33168 - DNA, 902 bp, Homo sapiens
accagagcgcgcggcgcgcagtcggccggcagccgcgggacagccttggcagaacagccgcggcgggagccccgcagccccgggctgggcccgcgtcccggagcgccaccggagagcgaggacgacgtggaggcggagtggcgcccggcgaggtagcgccaggcgagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactgtgagtatttttctccagtccttgtaagaagttcagaatactaaaacatatatttatagtagaatagtttagatacttgttgtctttgaggccataagaatatgttccttgctttatatttagactttaagctttgcatttcagattgttttataatagaatgt

SEQ ID NO: 33169 - DNA, 849 bp, Homo sapiens
ggaagttaacttttcttaatcgggtttctacaaggtagttcactattgtatgttttatttcttaccaaaacttttcttgggaaaatttgttttattgctccatacgtggtcaagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactgtgagtatttttctccagtccttgtaagaagttcagaatactaaaacatatatttatagtagaatagtttagatacttgttgtctttgaggccataagaatatgttccttgctttatatttagactttaagctttgcatttcagattgttttataatagaatgt

SEQ ID NO: 33170 - DNA, 1041 bp, Homo sapiens
acctgaattcccgggcctgagtctcagagcgcggtttgcatctttgcaggctgtaggcgcatgatgtcacaagttattggaagaaatccctccaacctaggttgggacagatgaaggcggcgcttattggtgttcaccaaaacaccagcatggtgtaccagctttggctagatgatgctcaggaaaacacagatcctggtgccgaacatgaggacagggcaggccgaaggagaaagtggaaggaggggagcttctctctcagcctcatccttctgggcctggatgctggagagtcatgaggtgcttcagagtactctgggtgaggagggaaagatggtgcccaccacatggaggccagcctaggtcttgtatgaaacctgtgagctagctgaaagcagagaacccagcagaggattctgggaaggtcctgggggatggcagagccagcagagagagggtatggatccaccaggcataggatggaacagagcactattgaccacagtgaactggggcatgggcaatcaataaacacatattagattaagctattgagactcagggatttttatacaactgacattccctaagaagccatgatcttcctgtctcaggaggtgcataagcagtggttgaatgttcaacagtcaagaatgttataaaaagaggttcttgggagagtggacctgatggccagcaaaaatcatagctcacatttattgagttattatggctcaggcatgtgcacatattcttttatttaaatctacaatatgctttatcatgctcattttatacatgaggaacacaaggcatggagaggttagataacatgcctaagatcatgaagcaagcaagggggagaaaagatacccttctcactccttccagacagctcacttcaccaccactccccactgtctctaaagcaaaagttatttgaaggcttagggactggtttggtattatccatgcagggcggtttgttttgtttttcttttaaaatttcagcctatgcttaaaagatttcatgtaaaaatt

SEQ ID NO: 33171 - DNA, 999 bp, Homo sapiens
ccccagacgggcctgtctaattgcaggaaaacaaactcagggctcccactgattctacattacggaggatctcatttctgtaccctgccctggaagttggcaaaaaataaatacctggagtgggattgctagatcacatggaaaacacagatcctggtgccgaacatgaggacagggcaggccgaaggagaaagtggaaggaggggagcttctctctcagcctcatccttctgggcctggatgctggagagtcatgaggtgcttcagagtactctgggtgaggagggaaagatggtgcccaccacatggaggccagcctaggtcttgtatgaaacctgtgagctagctgaaagcagagaacccagcagaggattctgggaaggtcctgggggatggcagagccagcagagagagggtatggatccaccaggcataggatggaacagagcactattgaccacagtgaactggggcatgggcaatcaataaacacatattagattaagctattgagactcagggatttttatacaactgacattccctaagaagccatgatcttcctgtctcaggaggtgcataagcagtggttgaatgttcaacagtcaagaatgttataaaaagaggttcttgggagagtggacctgatggccagcaaaaatcatagctcacatttattgagttattatggctcaggcatgtgcacatattcttttatttaaatctacaatatgctttatcatgctcattttatacatgaggaacacaaggcatggagaggttagataacatgcctaagatcatgaagcaagcaagggggagaaaagatacccttctcactccttccagacagctcacttcaccaccactccccactgtctctaaagcaaaagttatttgaaggcttagggactggtttggtattatccatgcagggcggtttgttttgtttttcttttaaaatttcagcctatgcttaaaagatttcatgtaaaaatt

SEQ ID NO: 33172 - DNA, 921 bp, Homo sapiens
acctgaattcccgggcctgagtctcagagcgcggtttgcatctttgcaggctgtaggcgcatgatgtcacaagttattggaagaaatccctccaacctaggttgggacagatgaaggcggcgcttattggtgttcaccaaaacaccagcatggtgtaccagctttggctagatgatgctcagaacaccagagactgggtaattaataaaaagaagaaattgatctggcctacagttctggagccttggaagtccgagatcaaggagctgcatctgggttctaggatgcctcataaaggcccgtagtgtactttctgtctacttcacttagctccgcatttgcaatttctgttaacatgcatacagttgaatggatggccaggatcaaagctatctgctgtgagacacaatgagaaatgcttttgtgtaaaggactcaatgatcacccgctccagaggatgcagcaaaaaggtgccatcttggaagcagagaccagctctcaccagacgctgaatctgctggctccctgatcttggacttcccagggtccagaactctgagaaataaatttctattgtttataatgtactcagtctgtggtattttgttatagcagcaggaatggactgagagaaaagcagctagttgaggatttgagaatttgggtgtttttttggtttttggttttggtttgagtgaatctttttgcaaaacattttagacattttatgtacaataaaatgcttccattttaaatatgcatttgagtaggctttagaaatgtatacaaccatgtaaacaccttaatcaagacacagaatgttttcataaccctcaaaagttcccttgtatccagttgcagtaaatctccccttctccccacccccaggtgactcctaatctgctttctatcagtttagaa

SEQ ID NO: 33173 - DNA, 1141 bp, Homo sapiens
acctgaattcccgggcctgagtctcagagcgcggtttgcatctttgcaggctgtaggcgcatgatgtcacaagttattggaagaaatccctccaacctaggttgggacagatgaaggcggcgcttattggtgttcaccaaaacaccagcatggtgtaccagctttggctagatgatgctcaggaaaacacagatcctggtgccgaacatgaggacagggcaggccgaaggagaaagtggaaggaggggagcttctctctcagcctcatccttctgggcctggatgctggagagtcatgaggtgcttcagagtactctgggtgaggagggaaagatggtgcccaccacatggaggccagcctaggtcttgtatgaaacctgtgagcaggagccaggccgtggcctgctgactgcatctgccagatgactaccaatgtgagattctctctcccttgctgtctttgaaaaagcaagttgccatgtgaagagggccatatagcataggagctgaaggcagcctccaactgacggcaagaaaatgaggtcctcagtctgacaacctgcaagaaactgaatgttctaaaagccacatgagcttgggagcagatctgaccccagccaaatctctgaagtccgcaggcaggaaatgaagatcagaaaaaggctattgtctcatgaatatgagccagactccacagaagctggagtccttcattatggagctaaacacatacacctggcttaggagtcagaaaaactgaaagagaattcagggaagtagagaaattgcaagcccagatgctgcttcataccaaagaagcaagtcagcaggtcagcaacaatgtgtatcagttccaaaatgacttacacaggtaccaagacaagacattatatacacttatatagtcaaatactttaaaactgttaacaaacttgctacaattgtctcatttgtcttttaaccttaatatcacagatcaagtttgtaatctcaaaagttcaccctggctgctgtgtggagtattctcttatctgctcatattacactgtgcttattcattcatcagttaatggaaatttgggttgtttcctgattttgactgtaatgaataatgttgctgtaaacattcatgtacaaaaaa

SEQ ID NO: 33174 - DNA, 1528 bp, Homo sapiens
acctgaattcccgggcctgagtctcagagcgcggtttgcatctttgcaggctgtaggcgcatgatgtcacaagttattggaagaaatccctccaacctaggttgggacagatgaaggcggcgcttattggtgttcaccaaaacaccagcatggtgtaccagctttggctagatgatgctcaggaaaacacagatcctggtgccgaacatgaggacagggcaggccgaaggagaaagtggaaggaggggagcttctctctcagcctcatccttctgggcctggatgctggagagtcatgaggtgcttcagagtactctgggtgaggagggaaagatggtgcccaccacatggaggccagcctaggtcttgtatgaaacctgtgagcaggagccaggccgtggcctgctgactgcatctgccagatgactaccaatgtgagattctctctcccttgctgtctttgaaaaagcaagttgccatgtgaagagggccatatagcataggagctgaaggcagcctccaactgacggcaagaaaatgaggtcctcagtctgacaacctgcaagaaactgaatgttctaaaagccacatgagcttgggagcagatctgaccccagccaaatctctgaagtccgcaggcaggaaatgaagatcagaaaaaggctattgtctcatgaatatgagccagactccacagaagctggagtccttcattatggagctaaacacatacacctggcttaggagtcagaaaaactgaaagagaattcagggaagtagagaaattgcaagcccagatgctgcttcataccaaagaagcaagtcagcaggtcagcaacaatgtgtatcagttccaaaatgacttacacagctagctgaaagcagagaacccagcagaggattctgggaaggtcctgggggatggcagagccagcagagagagggtatggatccaccaggcataggatggaacagagcactattgaccacagtgaactggggcatgggcaatcaataaacacatattagattaagctattgagactcagggatttttatacaactgacattccctaagaagccatgatcttcctgtctcaggaggtgcataagcagtggttgaatgttcaacagtcaagaatgttataaaaagaggttcttgggagagtggacctgatggccagcaaaaatcatagctcacatttattgagttattatggctcaggcatgtgcacatattcttttatttaaatctacaatatgctttatcatgctcattttatacatgaggaacacaaggcatggagaggttagataacatgcctaagatcatgaagcaagcaagggggagaaaagatacccttctcactccttccagacagctcacttcaccaccactccccactgtctctaaagcaaaagttatttgaaggcttagggactggtttggtattatccatgcagggcggtttgttttgtttttcttttaaaatttcagcctatgcttaaaagatttcatgtaaaaatt

SEQ ID NO: 33175 - DNA, 388 bp, Homo sapiens
tccagaagctgatagtgttgatcaacaaaatgagacaatttgtactataatccctggtttcagtagtttcttggttttgtctttctcatacctagactacctccttgtaactggaagtcacagacatgctatctaatgttccagcataatttttccttttggagtgaccctgagactagtgactgcagcccagactggctgaagtctgagcttggcccagtgtcaagatctgtcctaacattctcttgtattttcattttagctagtacaggtagcagtaacaaaggaattgtttcattaactttttttttttttttttagaggagtcttgtgctattgcccaggcttcgagtgcagtggctcactgaaggcttgaattcctgggctc

SEQ ID NO: 33176 - DNA, 4254 bp, Homo sapiens
  misc_feature (221)..(221): n is a, c, g, or t
  misc_feature (1162)..(1162): n is a, c, g, or t
  misc_feature (2730)..(2730): n is a, c, g, or t
  misc_feature (3714)..(3714): n is a, c, g, or t
  misc_feature (3779)..(3779): n is a, c, g, or t
ggaaaagaagacaatacaaataacttgaaaaggagtatgaactggatatggtcagagagacaaatcacatgttccatgctgctttaattggaaaacaattctttcatggggttactttcccttcagctgagataattaagtctggactgacactggtgaccagctactgatgataaatagtcagttactaacaatgcagcaatcagtaatcaaaatttatntttcccaggttaccagggcacagttgaagagaaaagtgggtttgataaggctgggagataggcttcctcgtgcagtattcacatggcttcttctccacagcatctgggtgggatcattaggtctgctttatttcaaccttgtcataaaagaaaacatacctattgtctgtgtttgcattagaaatactttgcacgccccatgctggaaaagaagtttctgtatgcctccctgtaatttttaatggattaaattatattctgtaagtgggttggcatgagggtaggtttcaatgtccagttgttattggacatgaaataaacttagatatttttaaagccactccatgcagctggcacaagtaaaggtttttgaatcatggctaattatccctggctgtggctgaaggcattgaaatgaaagggattaggattgtaatatggatgccatttgtatttgtatcagcggctccgatatttgtctactcactagaatcacctggggttctactaaaatttttcacagcccaggtcacacccaagccacttaagtcaaaatctctgggtatggaacacagacatctttaatttttgaagctctctaggtgattccaatgtgcaggcaagtttggaaagcactggtctatactcagttttatgcatatttttgcataaaaatatgaaactgctgtctaggccgggtgcagtggctcatgcatgtaatcccaacactttgggagactgaggcgggtggatcacttgagcccaggagttcgagaccggcctcggcaacatgatgaaatcccgtctctacaaaaaatacaaaaattagctgggcatggtggcgcgtgcctgtagtctcagactcgggaggctgaggcaggagaatcgcttgaacccgagaggtggaggttgcagtgagcagagattgcatcactgcactncagcctgggcagcagagcaagaccctgtctcaaaaagaaaagaaactgctgtctcccaccccagtaagaccttaaaccccaagagaaaaagcataatgtgacccacccggtgagaaaagcaacctcaaagtggtcaaaatagactcagctctgaggagaaggagaaccaaaaaaggaggaaacatgcctttgctcctttcttagtgcttagctcagtgttagttgaataaatgaataaaaagagaaaagaggaggtggtcatgtgcagctcagttcccagaaagggtactgggatgggatggaggaaactcattgaccacatccttgcacagtgggcacctctccacactgccctcctcgctctcctgatgaattctttcttttctctctagtttagtcaatctcctgtcttctctgggagcagtcattctgagatggtcgaagatgactgtctcaggggaggacactcattcagcttttaaaatgtcaggtgtcctttggggatgcttcaaaagcagcatttgggcttcctttgccataggaaatgaacaggaagaaaggccagtgaagacagagaacaagggggcaggtgcctgcccagaaatcaacgtgcagatagagaagggagaaaaaaaaaagttcccatctgcagtactggaatcccacttatggagcataaaataaaaaatatgaaggttatttgctttgagctcatctgattctttgtgttagactgcactgtggcctgcctttctgagtttgctacatttttatttgaaagctaataaattagccattcatatggcacgcaggcgggtttatagtgctgtgtaaaccaccagccaccatatacatccatctgcatcacagatcgactagaattatcactactgacaccacaatgcctataaattccctcacccgcatcctgtattccagaatatttctattggctgaccatactgcgaagagacgggatcctgggaaaaatccttttttctttctagtttagtgggaactggcaggttatcagtaggtctaagctctaggtttgcctctagagacaaagagtttaaaaaatagtaactagttttattttgttctaaaaaaacacatgcacaagaaaaatattgtcaataaaacataaaaatgtacaacataaaaagtgagtttcttacccaaatctgacctcctacacctcctccctcagagacactgttactagttgcttatatatgagaactgcaatattcacgacactttaaaaaatcagtcaatcttggcttgtatttcaagtttcattaacaaaaaacagccccctttacaatcactggggtactgaatgcactgatatttaaaaatacccaaagctatttggatcaaaatcaacaaatatttaataagtaccttcaatgtgcacaatgttgcctaaacaagccatttctaatgaggattttacacatatatgtttcatactttttttctggtgtataacaactaatctaaaattatgttagtgaaagggtagtcagtctttgttttaaatgtttttctcagaaacaaaaatnatctctttctctccctcacccctctaacttctcagcctttcacacattctctcatttgagttctgttttacgccgagacatctgggtaggtggtatgttctggccagagtactctctctcataccttccccagatggattggctcaaggatctaatattccccaaagaaataaaacatcccccaactggccattgaagaagagctgcagtgctttctattctaaacacacatgtgttgaaggatgagagacggtcatgacagagccagtgtccccacccatgacttgtctgcagagggggagacttccagtctgtagcccactgcaggatactaggctgactgcacagccccgttacccctcaaactccagccagctacatctgtatgtcttctctccagctggctggcccagctgttctggtgtcaaagaaagttatgagtcactgggaagggctttgagacaagagtagagttaaaccatctcctggggtctgtgtgtcattggcaatcgagccttagtaacaagccagtgcttgacagtcccaggaaggccacacaaccagagcttcactttgtattccacaatccacacctctgggctttgtagtgaaaaagaggtagagctgtatagatgctggatgtctccatccctagagactttctgtcattggccatgatgttcattaggttcttgccatctgtctccttgcaaatgctttttggctgtagatctatatcctatacaatctggtcaaactgggagacaatgaatgaggattggccaaagcctgaggactttcttttggtcttttgattccagggacattattacaacagagccctaggagcagctgccagcaagagtttgagtccacagcaggatccttctggaccatctgtggcttcctgctctgaacagtacttcctcactacgtgggaggaaagacttgtcagaggatccaagaaccataggcagtcaggtnctccatggggaccctaaatgttgtctggtctagccctgcatcctgcgtctaaattcctggagaanattccttctgtcctagcactcatctggcctccccatccccttaggtaggctagtccatgtgtgtgttacaggggctgctagaaagttcctccctattttgagcagaaatcatctttatagtttctacccattgatcttaggtctaccctcacaactgtcctctaggtttctcttcagatatctgaaaaatgccagtctctgccccttgcatctccccttttccttgttttagtactgatttttcagaaattgtcctgatactctttttttagagcttcattcactatttaatgaatatttgttaagagtttactgtacattagactttgttcttgaatgggagggatacagtgattaataagaccaatttacccacatagagcttacattctagtggaggggaggaacagacaaaagcaagtgaaaatctcaattaggaacaaatccattgcagaaatgtagaataaagtgatga

SEQ ID NO: 33177 - DNA, 725 bp, Homo sapiens
ttaatgaggcattagtggtggtggatgaggggtggccagaaactaaacagcaaaagcaaagagaaagctgcagaaaccataagtaagcagaggtcatgagacatttgtataatgagatcacggagccacagggtggcagaagccatgaagcagcaaggcaacaatgggctagaagccatgaagcaataggagccacgaggaacagaaaccgtgagacaaaactgactatgagatccacaaagcagcagaaggcttgaatagataagatcatgagacagtagaagcgatgagactgcaagaaccacaaggtagccagaaccatgtggcaacatggcaacaggaatggaagaggcagcaggagctacaatgcagaaaagccatggattaataggaactgaagcgccgggagccatgaagctgcaggacccatgaggcagaaaaagccatgggctagcatcgaggggggcagaaagaagttagtcagtagcagtaggaggagtataaatacagccagaaaggagttgagtcaccaatttgggaagcactagagaagggagcaacagatgcctgcagctgagggggtgacaagataagccaggctctagagctgctttggatcatgaaccattttcaagtttctgttcttccatgaggctgcctgtgtagctgttcttgtcttccttatttccctgtgaatgctttaataaatccccatcactaacctg

SEQ ID NO: 33178 - DNA, 422 bp, Homo sapiens
gccccggcctcccatgctcaagacattggcccacctcagtttccagaatagctgggactaccggcaagcacaaccatgcctggctaatttttgtattttttgtagagaccgggttgcgccacatttcccaggctggtcttgaactcctcggcctaccaaggtgttgggattacagttgtgagccactgcaccagctacagaaggcttctctaaggaagcaacttttgagtccaaatctggataagtgtcattcaagggacagggcattctagctggaaagacagcctacaaaagtgtgaagggggaaatgtactttggacattaagtgtataaaagggccagtttgggaagggcatggtggctcacacccataatcccagcactttgggaggccgaggtgggtggctcacctgaggtcagga

SEQ ID NO: 33179 - DNA, 589 bp, Homo sapiens
tgaggaagggctgaaagacctgaaggtcagggctagagatgggagctagcatcccaccctttcctgccctgctgatctgaattaagtgaacagagtgaccagatcatgagcctaaagctgtgttcttcctccactcattcttcattcattctacagatatttactgagcacatactatgcaccaagcatgatgttaaatcctggagagagatcaatcaacaagacatatggtctctgaactccaagaagtcgtagtcaggagacttgtatcctgagagctcctcatggttcactgaagctgggggcagcatggttgaggggaaagagccctggaattggagtcagagatctgatactggttctaacttaactgtgtaacattggtcaagttcattctcctctgtaggcttccctttccctgtctgattcagggatcttgtcattgcaaagatggggcctactctaccagcttaaataaaacagagcaacaagaaggacagaaaagtatctgacaggagccaaggccccgcaacggactggaagtcagggactgaggttcctctccaggagtcactcacctctgcttctc

SEQ ID NO: 33180 - DNA, 791 bp, Homo sapiens
aaagacaatctgtcaaggtgagacttagagactaagtctcatttgggttgtctcctagaagaagggtttataaagttgacagtttagggcagaaccttaaactgactccaggtgagagtttcttgcttttgaaaataaagatcttgaagggaagattgttcccacatgaggtgggaacaggaggacatgttgagctcccagagttaaatccttaggtttctctgcctcatcaccagggactgatagactcttgggcccctttcaacagagtctgactcccaagcttgggaatatgtttgtcacttggcgttttccttgtaaatggtagtgcagtgtagactgcttaaatgaaccaattcagatgtttccttttcttccgtttttattcctttatagaatattgctgtcatataactcccctttttcccatatattaaataactgtattcccttgttggtgtgttttaattttttggctgaaaatgagtaggcaggccgggcacggtggctcactcctgtaatcccagcactttgcaaggccaaggcaggtggatcatttgaggtcaggagttcgagaccagcctgaccaacaaggtgaaactccgtctctactaaaatacaaaaattagcctggtgtggtggtgggtgcctgtaatctcagctactcaggaggctgaggcaggagaattgcttgaacccgtgaggcagaggttgcagtgacccgagatcatgccacgccactgcactccagcctgggcgacagagcaagactctgtctcaaaaaaaaaaaa

SEQ ID NO: 33181 - DNA, 441 bp, Homo sapiens
cccatcatcaccaatcaccagaaaaatgcaaatcaaaaccatctcacaccaagtcagaatggcttttgttagaaagcttaaagacagcagtggctaacaaggctgtttagaaaggggaatacttattcaccactggtggaatgtaaattactccagccactgtggagaacagtttggagatttctcagagaactaagagtggaactactgtttgatctagcaactatattatgggtttataccctaaggaaagtaagtcattctactaaaaggacacatgaacctgtatgttcatcgcagtgctatttgcaatagcaaagacatggaatcaccccaggtgcacatcaactctggattggataaagaaaatgtggtacctctatgccagggaatactatacagccataaaaagaataaaatctgcagcaacatggatgcagc

SEQ ID NO: 33182 - DNA, 627 bp, Homo sapiens
  misc_feature (4)..(4): n is a, c, g, or t
  misc_feature (6)..(6): n is a, c, g, or t
  misc_feature (16)..(16): n is a, c, g, or t
  misc_feature (37)..(37): n is a, c, g, or t
  misc_feature (46)..(46): n is a, c, g, or t
tacntnttccacttgncgacatttgagatccgattgncatcgacgnctggagctactcaacattgtggagggaatttaccagctgaagaaagcctgccggcgagagctacaaactgagcaaggccagctgctcacacccgaggaggtcgtggacaggatcttcctcctggtggatgagaatggagatggccagctgtctctgaacgagtttgttgaaggtgcccgtcgggacaagtgggtgatgaagatgctgcagatggacatgaatcccagcagctggctcgctcagcagagacggaaaagtgccatgttctgaggagtctggggcccctccacgactccaggctcacccaggtttccagggtagtaggagggtccctggctcagcctgctcatgcccactcttcccctggtgttgacttcctggcaccccctgtgcagggctgagtggggatggggaagggctgctgggtttgaagtggccaacagggcatagtccattttggaggagtccctgggatggtgaagggaattctactccagggtgatcattctcttgaggggctgagaggtggttcctcgattttcactaccacattagcttggctctctgtctcagagggtatt

SEQ ID NO: 33183 - DNA, 267 bp, Homo sapiens
agccgcaagcttgaggtctgagactgcaggatagttggcataagacgtgtaggcgcatcctgggagcgaggtctctcctcctgcccccagacccaggtctccccttcttctacatgaccacctctcctcccccttgctcaggccagctgtctctgaacgagtttgttgaaggtgcccgtcgggacaagtgggtgatgaagatgctgcagatggacatgaatcccagcagctggctcgctcagcagagacggaaaagtgccatgttct

SEQ ID NO: 33184 - DNA, 967 bp, Homo sapiens
ttttcctgagtttaggtgatatggtgtttgtacctattgtagtacagcaaagaataacaccagaaataactttaaaaaattatttggcctcaaatattcttattaacagaatggagctgggtataagttcattaataaattaaaaaaaaaaatcctgtagctgctacttttccaaatgtagtgactcagaaaaggacaggtataagcaaaaggaagaactctgcagtggtggtcatttcattctcggttgctaagccttagatttcttgcctgtttccttctggtgaagtataggggaaaaacatgaccatgttgctcctgtgtctttggagttccctgactcctcccatcaagcctgagagccctctaggattaggatctttctgactgttacaccacccaagagttgagtcttacttacattccactgtatgcagtaaatacaaaatgaacagaggtttagaatgttattattgtgagtctgaagctaaacactagtttgaactataaagatattttaacagtctttttatgaaaaggtattacgtctataatgtcactggaccctgaaagttagcactgaaaaggaatactgattttgtttttgagtccccttctgtgcagaatgttttatttccagttgcaccagttcaacttaatatatattatatacagtttgtttgtgagacattggattggttattgatagtggatacaaaaatgagcaatattctgttcttgccctcaggaagtttacagtttaataaggcagataagcaggattacttataaatctaatattaggcaaatgtaggtgccacacaagaatatttgtaaaggccaggcaccgtggcacatgcctgtaatcctagcattttgggatgccaagacaggagaatcacatgagcccaggagttcgagacctgtagtcccagctactctagaggctcaagtaggaggatcacct

SEQ ID NO: 33185 - DNA, 435 bp, Homo sapiens
  misc_feature (6)..(6): n is a, c, g, or t
  misc_feature (176)..(176): n is a, c, g, or t
gatttnacttgagagaaggtgagtacaagcaatttgcagttgttgtaatgacagattactgcgcaagtgtgaatccaaacagtatagcttttaaattttaaagcatttggtaaattatcgctgagtttttttctgttgccaatagcaaactgcttttccattaatggagaattcangcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaatttgaaaa

SEQ ID NO: 33186 - DNA, 290 bp, Homo sapiens
aattcaagcttctaacgatgtacggggacatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaatttgaaaa

SEQ ID NO: 33187 - DNA, 1510 bp, Homo sapiens
ttggatgtgatgacttatactaattgactgttgaatgtcaaaccaaacttaacattcttgtaatagaaaccagcagggtgtgtacacttttgtgtgtgtgtgcaggtttatacacataaacacaataatacttggacttatttatttaaaatttagatttattagagggagcatggccataaaataaaataaaataaaatttaggatttaagtcgagctcagtggctcacatctattatccccgcactttggaaggccaaggcagggtagattgtctaagctcaggaatttgagaccaacgtggtgaaactcggtctctacaaaaaccacaaaaattagccaggtatggtgtcacatgcctgttgtcccagctacttggagggctggggcaggagtattgcgtgagcccgggaggttaaggctgaagtgagtcatgttcacgccactgcactacagcttggataacaaagcgagactctgtctccaaaaataaaataagtaaataaataaataaataaaatttagatcaatttgctgttatatttttatataaactatgtttatgacataagtataaacaaaaaaataaaataagtaaataaataaataaaatttagattaatttgctgttatatttttatataagctatttattatgaatttgtttatttctcctttgagttttgttagtttttgttttatgcatttagaggttgtgttattaggctcatacccatttaaaattgacgttttctggtagagtgaacctttattatgtgaaatggctttctctaccactcacaatggtatttttttcactttcccccttatttttgaattttcaatgttcttataatgatgtcatgtctcttgaatagagttgttttaatcaagtctgtcaaattttgtcttttgtgtatttcgtgaatttacatttattgtaattactgatatagttgtgttcataaataccatcttactacttgtttccatttgtcttacccatttttgtttttattttttcttttctgttgctttctttctgattatttttttaattccgtttccccccctaccattggttctacttacacattcttttataatttctttagtggtttcctccacagattacaacttctgtacattattataatctaatacaaattttactttttattgtttcccagacaatgctatgatctcacaatactcaatctctatttacctccattctactcttgcatgtatattattattactcattttaatttcacatatattttacacctaacgagacattattattattgctatgtgcagtcaatattcatttgtattcacccacatattcactctgtttttttttattatttcctgcatttctgtgattctatcatagatcagttttcttctacctgaagaattccctttagtattttttgtgtatgcacatctgctggcagcaaattttctcaggtttttttgtgtttttttgtttgcttgtttt

SEQ ID NO: 33188 - DNA, 1713 bp, Homo sapiens
ttggatgtgatgacttatactaattgactgttgaatgtcaaaccaaacttaacattcttgtaatagaaaccagcagggtgtgtacacttttgtgtgtgtgtgcaggtttatacacataaacacaataatacttggacttatttatttaaaatttagatttattagagggagcatggccataaaataaaataaaataaaatttaggatttaagtcgagctcagtggctcacatctattatccccgcactttggaaggccaaggcagggtagattgtctaagctcaggaatttgagaccaacgtggtgaaactcggtctctacaaaaaccacaaaaattagccaggtatggtgtcacatgcctgttgtcccagctacttggagggctggggcaggagtattgcgtgagcccgggaggttaaggctgaagtgagtcatgttcacgccactgcactacagcttggataacaaagcgagactctgtctccaaaaataaaataagtaaataaataaataaataaaatttagatcaatttgctgttatatttttatataaactatgtttatgacataagtataaacaaaaaaataaaataagtaaataaataaataaaatttagattaatttgctgttatatttttatataagctatgtttatgacagactttcctataatattcttatcataatgttcttgcacttgaaagaatgtgcattctgcagttgtgtgcaggtgttatgtgtatttcaactgggtcaagtttgttaatcaggttggtcaaattatctacgtctttactgatatttttgtctgtttttctataaattactgagagaggataaagcctgccactgttattatgaatttgtttatttctcctttgagttttgttagtttttgttttatgcatttagaggttgtgttattaggctcatacccatttaaaattgacgttttctggtagagtgaacctttattatgtgaaatggctttctctaccactcacaatggtatttttttcactttcccccttatttttgaattttcaatgttcttataatgatgtcatgtctcttgaatagagttgttttaatcaagtctgtcaaattttgtcttttgtgtatttcgtgaatttacatttattgtaattactgatatagttgtgttcataaataccatcttactacttgtttccatttgtcttacccatttttgtttttattttttcttttctgttgctttctttctgattatttttttaattccgtttccccccctaccattggttctacttacacattcttttataatttctttagtggtttcctccacagattacaacttctgtacattattataatctaatacaaattttactttttattgtttcccagacaatgctatgatctcacaatactcaatctctatttacctccattctactcttgcatgtatattattattactcattttaatttcacatatattttacacctaacgagacattattattattgctatgtgcagtcaatattcatttgtattcacccacatattcactctgtttttttttattatttcctgcatttctgtgattctatcatagatcagttttcttctacctgaagaattccctttagtattttttgtgtatgcacatctgctggcagcaaattttctcaggtttttttgtgtttttttgtttgcttgtttt

SEQ ID NO: 33189 - DNA, 163 bp, Homo sapiens
ccactggggaaaaacgggctctgggtgaccccctcatgggaaagacggagcatagggaagcctatacatggattccttcagactgtgcctgtctttttccctcatgatccagatgtgtatccttactacaatgcaataaatcttcactgtgagtacaaccata

SEQ ID NO: 33190 - DNA, 175 bp, Homo sapiens
acaggctaagattctgggtgaggaggaatccctagacagagaggaaattttgctatttgttatcaggtaatagatcatgtttcacttggaaaaacagctgggaagatggaagtttattggaaagctggccagatctcctgagccaggggtatcaataaactctctcaagtagtga

SEQ ID NO: 33191 - DNA, 425 bp, Homo sapiens
accccatctcttaaacagaccaaccagccaaaaaatgtaggggtagggttagaaagctaagttgagaaaaatgattgatggtggtaattcagtgtgacagctcctgcaaacacatcatggagtgccacagagagctcaccatctccacaattttctattcgtttggtgacccttaaaggtatagcacattagaaaaagtgggctcacattaaaatacactgtgcatgtattgctgtgactgtgagatttttttttctgctttggagccaaatgggagtagcagctgcttggcccccttgtaacacatgtggagtttgtgtcggccatgggctcatctgccccagaattcggctgccacctaagtgcccttcacatagtcctgccagccctcattgctctgttaggatctgggagttaaaaaaaaa

SEQ ID NO: 33192 - DNA, 713 bp, Homo sapiens
tctacccccagccccagccttcttctggcactcagagaagtcagccaagcttcgattgtttgatggggaggcatggcctgacaactaatgactcagagctaccagtctctggcctctccaaaatgccaagaactcatcgatctgcagaccttgtaaccctcaaggaatcactataccctcaatggatatgaaaatagacaccactgtgattcaagaaggtgatctaagaaagaagcacagtgaaaatttataccagagatttcaacatgggagggtggaaatctagaggtagggagaggtgagtaaagcagtggaaacattagacccagttcacctgccttgaaatctcagctctctttcttactaaatcctacctactatgtgacctttttgttaggctgtttttgtgttactataaagaaatatctcaggctgggcatggtggctcatgcctgtaatcccagcactttgggaggcccaggcaggcagatcacctgaggttgggagtttgagaccagcctggccaacatggtgaaacggcgtttctattaaaaatacaaaaaattagccaggcgtggtggtggcggctgtaatcccagttactcgggaggctgaggtaggagagttgcttgaacccggcaggcagaggttgcaatgagccaagatcacggcattgcactccagcctgggccacaagagcagaattctgtcta

SEQ ID NO: 33193 - DNA, 323 bp, Homo sapiens
tcttttttttttttaaattgtggacttaaagaaaaatattttatttttaatgccttttcctgggataagcattaaagatgcccaaaaagaaaaaaaaaacaaaagaatgatagtgatggtaaggcaagattctagcaaagagagatgggagataaatggctgagagttcaggtgaatatttaatatattaaaaattgtattaaagtttttcaaggtattttaaaaataactattttgatactagaaaaaaagtccattttttaatttaaatatgagatctatgtacaattttaataaaatcctgtccatgaaacacgcatggc

SEQ ID NO: 33194 - DNA, 419 bp, Homo sapiens
aatttctatatttgtaatgttttataatatgtataatatattggtacactagtatataaaatttacaattcacaaataaatataaatattttggaggttgtttaggctacattttttaacaatgatgtgcctgaataaaaccattggtgactctcctagatttttacaaattagttaatacctttgcccagcaaattccccagccttccagttgtaatgccaagcttctttggggaagctcctctgggtctgtccctaattgtgctgtctggcccttgatttcatgcctggctttctccacaagactgggagggtccttgtttttcttaaaggctggcatatagtctaggcacacacattggactactgcaatatgaactgcatctactgcttgtccctgttctctcccccttccagaa

SEQ ID NO: 33195 - DNA, 498 bp, Homo sapiens
ccgggcgtggtggcagcactatgggaggccaaggcgggtgaatcatgaggtcaggagtttgagaccagcctgaccaacgcggtgaaaccccgtctctactaaaaatacgaaaaattagccgggcatggtggcacgcacctgtaatcccagctactcaggaggctgaggcaggagaatcgcttgaacccaggaggcagaggttgcagtgcaccaagatcgcaccattgcattccagcctgggtgacagagcgagactcttgtctcaaaaaaaaaaaaaaaaagaaacttgagaggtgagggtcacacaggttcagaaagatgagtctttgggggtcacagggcttcagagataatggcaccactgaaaggttacaaagaggacagagtagcagcattactggggagttgtcccagaaaatgaggtatttgtaggttagggagattgacagaaatagaatcatcgagagtataaaacgatttccaagagagaggaacact

SEQ ID NO: 33196 - DNA, 270 bp, Homo sapiens
  misc_feature (265)..(265): n is a, c, g, or t
gcatcagccactgcacccggccagaaagcttattttaaaaggtgtgtatagagccccttatgtttctgcttgattttttaaataacatatttatgtctatatattttaggatgtaatatctcactgtatgtgttgctttgcatcattgaacatttttggtaattattttctatatattttagatatttcattaaactaatacagaatttcatattcagggccactgcactcggcctaattttttttttttctgaagagatgaggncttgc

SEQ ID NO: 33197 - DNA, 432 bp, Homo sapiens
tcacttctaagatttggttacaaagagactgtggcttttatcttgggtgcttgccctctctacctttctctcagagcccctacactgttaagtagccttgtgggaaggcccaagagccagtgatgtctaggcctaacagctagtgacctgccagcagccaggtgagtgagtttggtggtggatccttgatagtcaagctttaatgattgcagccccagccaacaccttgactgcagccttgtgagagtccctgaaccagaagcacttagcttacccagctggatttctgatccacataaactgagataataaatgctgttttaagctactgtgattgaaaatgaattgttacatagaaatagataactaggccgggtgtggtggctcacatctgtaatcccagcacattgtgaggccgaggcaggcggatcg

SEQ ID NO: 33198 - DNA, 478 bp, Homo sapiens
aatctaaatataattaacattttctgtgccatagctagtttgttaacatttttaatgattaatattttaggtgtatgaaccatagtatatttaatcatttcattgtggttcgtttataagttttttttaagatttgtatttatgttcatgataagcacgtccattattcatgtggcggtgggatggaagtaaagcagtacctgttgtccccgtaagtttacctttccaagaatgaatctgtagctgtctttgatggcagtagcttgttgtgcagtagagctgaagaaaacaaggaatgaaagaagatagcctgtttccccatttaggcttgagaattcttttttaggtagtgcagagcatatgttcttgaccttcagtccaggagtgtctaaggatccacaaatacagtcatccgtctgtatccatggtttcgtatccttggattcaacagactgcaggtggaaaattactctaaagg

SEQ ID NO: 33199 - DNA, 226 bp, Homo sapiens
aattttgtctctgtgtcgaaatatttcaaacttcttcaccattactattgagccagtgttcacttaccattctgaaaatcctagggcccttaaggattgtgctaaatctactctgggtgtgccctataaatgcaacagcaaagcctggatgatagtacaactgtttacaacatggtttactgaatactttaagcccactattgagaccaacagctcagaaaaaaaa

SEQ ID NO: 33200 - DNA, 749 bp, Homo sapiens
attcatccccgtttcttcactgtaaaaataacacgttttttgtagatgacttggaaaatacagacagccatatgttagaagtaaacaaaaccactcctaacccgtctacttcttaaaagccggtacttaacatttgaagcgtatttcttttcatcgctttgttttaaggtttttgtggaatatttttcatcatttctatttagagggtccctttttcttcacttaacatcaataccctaagcatttcttcctgttgctaagttcacgtgcaccccttccctaactgcataatactgggtcatatgggggtatcataattgacataaccaatgcccaaatatgggaacatttaagattggctctctctcttcaatttttcattttaagactggcattaccatctactttccccgagcacggacttttgttcctgttccagattgtttctctagggatcaattcctagaagtggattgcttgattctcagggtgatacatatgccaaatagtataccagagtattgaaggtacttgtttctaggaatcccactttgacatatcgacgatgagaataattaatattcaaatagcctgacctatgtcaggcactgtgtaccacaaactagcttacaatggggctacactgttgtgccaccgggttttacatgtgaagaaaccatggtttgcagtgagccaagattgcgccattgcactccagcctgggcaacagagcaaaaacttcatccaaa

SEQ ID NO: 33201 - DNA, 619 bp, Homo sapiens
agaagctggcaaatgccagaaaaccgattctcccctaaaacatccagaaaggaatgcagccctgccaacatcttgattttagcccagtgacacccttgtaggactttggacctccagatctgtaagataatacatttgtgttgttttaagccatgaagtttatagtaatttgtttcagcagcaacagaaaacaaatacatttgtattgttatctccttccctgagttttggcagccagaacctgtctcagagatctattcctgttctcactgtggtcctcttcccttcacctagctcactccttcccctctaatattctattcctctacatctgcttgggaaagtataaacctcatattctaagtctttgctggctttggttatagaaaatacacagccgtgttgtctcattctattatctgtcagtagcagaaacctgaaattggtagcttcaacaaactagtgtttgcttttctcttgaataaaggaagtcaggaggtaaatatatgatcaccttttaattactttttaaaatatttcttaggttttgttaacaatgggaaactgcttacatttcttttgaaaattaaaatgaattataaagttaaaaagaaaaaaa

SEQ ID NO: 33202 - DNA, 3374 bp, Homo sapiens
gcgggacacagtctcttctcctctgctcttctttgggcagagggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagagtgaagactagaaggaagaaagcagcccagccagtgcaaaacacggatgatgtgaaccccgtcatggtctcaggctccaggggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatgccacctgggcaacagagcgagactccaactcagaaaaagcaaaacaaaacaaacaaacaagcaaaaaaccacaattagactgacagctgacttttttaggagcaatattggaaggctaaatgcaatagaaagatgtctttgatgccttaagagaaataaatgttgttttagaaagcctactcaatgaaaacacattttaagactgaaagtgaaatatagatattttaaggaaaaccaaaatatgtgagtgttaataaagaaaagatttctcaaataaattctaaaacatataattcaggtattaggaaagtgatcccagattagatttttgagatccaaaaaaaatgaaaacctaggaaagtagcaaatatgtgagcaaaatgaaacaaatacttgttgtaaaaatgatggtttgtagaggggtcaaacatcaaatgtaatattgaaataccaatattatatagcccagaaactataataacataaagttcagaagagtgtaaatagaatttatattacataaagtctttatatttttccagagaaaattaaatgttatgatgaatgttacatttggataatttattattgtaatctcgaggaaatttacttaaagaatcgaagccaagtttaccacctgtgaactagaggaagtataaaaggtgatagaaacattattcagtcaaaccagagaagacaagaaataagagattaaagaaaaaaaggatggatagaacatgtagaatacaagtataagattctgtatttagactcaaatacagtctaagaatcacattaagcacaagtgaattaaatgctacagttaaaataccagcatagtaagactgggggaaagtgtagctatacgttgtttataagagatctacataaaagataaatataggggaggttgtgtgtagaaggatgaaaaaagacataccatgaaaaccgtaaccaaaagaaactgatgtagtcagtcaagtttccactggaaaaaacaagtctgtaggatgtatgtattgaaagattcaactattcacaatagcaaagacatggaatcaacctaaatgcccatcaatgatagagtgggtaaagaaaatatggtacatatactcaatgaactactatgcagccataaaaaagaatgagatcatgtcctttgcagggacatgaatggagctggaggccattatccttagcaaactgacacaggaacagaaaaccacataccacatgttgacacttctaagagggagc

SEQ ID NO: 33203 - DNA, 3320 bp, Homo sapiens
gcgggacacagtctcttctcctctgctcttctttgggcagagggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagagtgaagactagaaggaagaaagcagcccagccagtgcaaaacacggatgatgtgaaccccgtcatggtctcaggctccaggggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttagaccacaggacttctgtccaagagaactgagttcaactccatctatgccacctgggcaacagagcgagactccaactcagaaaaagcaaaacaaaacaaacaaacaagcaaaaaaccacaattagactgacagctgacttttttaggagcaatattggaaggctaaatgcaatagaaagatgtctttgatgccttaagagaaataaatgttgttttagaaagcctactcaatgaaaacacattttaagactgaaagtgaaatatagatattttaaggaaaaccaaaatatgtgagtgttaataaagaaaagatttctcaaataaattctaaaacatataattcaggtattaggaaagtgatcccagattagatttttgagatccaaaaaaaatgaaaacctaggaaagtagcaaatatgtgagcaaaatgaaacaaatacttgttgtaaaaatgatggtttgtagaggggtcaaacatcaaatgtaatattgaaataccaatattatatagcccagaaactataataacataaagttcagaagagtgtaaatagaatttatattacataaagtctttatatttttccagagaaaattaaatgttatgatgaatgttacatttggataatttattattgtaatctcgaggaaatttacttaaagaatcgaagccaagtttaccacctgtgaactagaggaagtataaaaggtgatagaaacattattcagtcaaaccagagaagacaagaaataagagattaaagaaaaaaaggatggatagaacatgtagaatacaagtataagattctgtatttagactcaaatacagtctaagaatcacattaagcacaagtgaattaaatgctacagttaaaataccagcatagtaagactgggggaaagtgtagctatacgttgtttataagagatctacataaaagataaatataggggaggttgtgtgtagaaggatgaaaaaagacataccatgaaaaccgtaaccaaaagaaactgatgtagtcagtcaagtttccactggaaaaaacaagtctgtaggatgtatgtattgaaagattcaactattcacaatagcaaagacatggaatcaacctaaatgcccatcaatgatagagtgggtaaagaaaatatggtacatatactcaatgaactactatgcagccataaaaaagaatgagatcatgtcctttgcagggacatgaatggagctggaggccattatccttagcaaactgacacaggaacagaaaaccacataccacatgttgacacttctaagagggagc

SEQ ID NO: 33204 - DNA, 3198 bp, Homo sapiens
gcgggacacagtctcttctcctctgctcttctttgggcagagggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatgccacctgggcaacagagcgagactccaactcagaaaaagcaaaacaaaacaaacaaacaagcaaaaaaccacaattagactgacagctgacttttttaggagcaatattggaaggctaaatgcaatagaaagatgtctttgatgccttaagagaaataaatgttgttttagaaagcctactcaatgaaaacacattttaagactgaaagtgaaatatagatattttaaggaaaaccaaaatatgtgagtgttaataaagaaaagatttctcaaataaattctaaaacatataattcaggtattaggaaagtgatcccagattagatttttgagatccaaaaaaaatgaaaacctaggaaagtagcaaatatgtgagcaaaatgaaacaaatacttgttgtaaaaatgatggtttgtagaggggtcaaacatcaaatgtaatattgaaataccaatattatatagcccagaaactataataacataaagttcagaagagtgtaaatagaatttatattacataaagtctttatatttttccagagaaaattaaatgttatgatgaatgttacatttggataatttattattgtaatctcgaggaaatttacttaaagaatcgaagccaagtttaccacctgtgaactagaggaagtataaaaggtgatagaaacattattcagtcaaaccagagaagacaagaaataagagattaaagaaaaaaaggatggatagaacatgtagaatacaagtataagattctgtatttagactcaaatacagtctaagaatcacattaagcacaagtgaattaaatgctacagttaaaataccagcatagtaagactgggggaaagtgtagctatacgttgtttataagagatctacataaaagataaatataggggaggttgtgtgtagaaggatgaaaaaagacataccatgaaaaccgtaaccaaaagaaactgatgtagtcagtcaagtttccactggaaaaaacaagtctgtaggatgtatgtattgaaagattcaactattcacaatagcaaagacatggaatcaacctaaatgcccatcaatgatagagtgggtaaagaaaatatggtacatatactcaatgaactactatgcagccataaaaaagaatgagatcatgtcctttgcagggacatgaatggagctggaggccattatccttagcaaactgacacaggaacagaaaaccacataccacatgttgacacttctaagagggagc

SEQ ID NO: 33205 - DNA, 3042 bp, Homo sapiens
gcgggacacagtctcttctcctctgctcttctttgggcagagggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatgccacctgggcaacagagcgagactccaactcagaaaaagcaaaacaaaacaaacaaacaagcaaaaaaccacaattagactgacagctgacttttttaggagcaatattggaaggctaaatgcaatagaaagatgtctttgatgccttaagagaaataaatgttgttttagaaagcctactcaatgaaaacacattttaagactgaaagtgaaatatagatattttaaggaaaaccaaaatatgtgagtgttaataaagaaaagatttctcaaataaattctaaaacatataattcaggtattaggaaagtgatcccagattagatttttgagatccaaaaaaaatgaaaacctaggaaagtagcaaatatgtgagcaaaatgaaacaaatacttgttgtaaaaatgatggtttgtagaggggtcaaacatcaaatgtaatattgaaataccaatattatatagcccagaaactataataacataaagttcagaagagtgtaaatagaatttatattacataaagtctttatatttttccagagaaaattaaatgttatgatgaatgttacatttggataatttattattgtaatctcgaggaaatttacttaaagaatcgaagccaagtttaccacctgtgaactagaggaagtataaaaggtgatagaaacattattcagtcaaaccagagaagacaagaaataagagattaaagaaaaaaaggatggatagaacatgtagaatacaagtataagattctgtatttagactcaaatacagtctaagaatcacattaagcacaagtgaattaaatgctacagttaaaataccagcatagtaagactgggggaaagtgtagctatacgttgtttataagagatctacataaaagataaatataggggaggttgtgtgtagaaggatgaaaaaagacataccatgaaaaccgtaaccaaaagaaactgatgtagtcagtcaagtttccactggaaaaaacaagtctgtaggatgtatgtattgaaagattcaactattcacaatagcaaagacatggaatcaacctaaatgcccatcaatgatagagtgggtaaagaaaatatggtacatatactcaatgaactactatgcagccataaaaaagaatgagatcatgtcctttgcagggacatgaatggagctggaggccattatccttagcaaactgacacaggaacagaaaaccacataccacatgttgacacttctaagagggagc

SEQ ID NO: 33206 - DNA, 3165 bp, Homo sapiens
gcgggacacagtctcttctcctctgctcttctttgggcagagggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatgccacctgggcaacagagcgagactccaactcagaaaaagcaaaacaaaacaaacaaacaagcaaaaaaccacaattagactgacagctgacttttttaggagcaatattggaaggctaaatgcaatagaaagatgtctttgatgccttaagagaaataaatgttgttttagaaagcctactcaatgaaaacacattttaagactgaaagtgaaatatagatattttaaggaaaaccaaaatatgtgagtgttaataaagaaaagatttctcaaataaattctaaaacatataattcaggtattaggaaagtgatcccagattagatttttgagatccaaaaaaaatgaaaacctaggaaagtagcaaatatgtgagcaaaatgaaacaaatacttgttgtaaaaatgatggtttgtagaggggtcaaacatcaaatgtaatattgaaataccaatattatatagcccagaaactataataacataaagttcagaagagtgtaaatagaatttatattacataaagtctttatatttttccagagaaaattaaatgttatgatgaatgttacatttggataatttattattgtaatctcgaggaaatttacttaaagaatcgaagccaagtttaccacctgtgaactagaggaagtataaaaggtgatagaaacattattcagtcaaaccagagaagacaagaaataagagattaaagaaaaaaaggatggatagaacatgtagaatacaagtataagattctgtatttagactcaaatacagtctaagaatcacattaagcacaagtgaattaaatgctacagttaaaataccagcatagtaagactgggggaaagtgtagctatacgttgtttataagagatctacataaaagataaatataggggaggttgtgtgtagaaggatgaaaaaagacataccatgaaaaccgtaaccaaaagaaactgatgtagtcagtcaagtttccactggaaaaaacaagtctgtaggatgtatgtattgaaagattcaactattcacaatagcaaagacatggaatcaacctaaatgcccatcaatgatagagtgggtaaagaaaatatggtacatatactcaatgaactactatgcagccataaaaaagaatgagatcatgtcctttgcagggacatgaatggagctggaggccattatccttagcaaactgacacaggaacagaaaaccacataccacatgttgacacttctaagagggagc

SEQ ID NO: 33207 - DNA, 2216 bp, Homo sapiens
  misc_feature (23)..(24): n is a, c, g, or t
cttcccctccactcccttccccnnccctgcaaatctctctgagtctctttgtgcattggaaaccagaaggcagggctggtggtgtcctgggagcagtctggggagctagcatcacaaccctggttttcctctgtgtttgcttcatcttcagagtgaagactagaaggaagaaagcagcccagccagtgcaaaacacggatgatgtgaaccccgtcatggtctcaggctccaggggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatgccacctgggcaacagagcgagactccaactcagaaaaagcaaaacaaaacaaacaaacaagcaaaaaaccacaattagactgacagctgacttttttaggagcaatattggaaggctaaatgcaatagaaagatgtctttgatgccttaagagaaataaatgttgttttagaaagcctactcaatgaaaacacattttaagactgaaagtgaaatatagatattttaaggaaaaccaaaatatgtgagtgttaataaagaaaagatttctcaaataaattctaaaacatataattcaggtattaggaaagtgatcccagattagatttttgagatccaaaaaaaatgaaaacctaggaaagtagcaaatatgtgagcaaaatgaaacaaatacttgttgtaaaaatgatggtttgtagaggggtcaaacatcaaatgtaatattgaaataccaatattatatagcccagaaactataataacataaagttcagaagagtgtaaatagaatttatattacataaagtctttatatttttccagagaaaattaaatgttatgatgaatgttacatttggataatttattattgtaatctcgaggaaatttacttaaagaatcgaagccaagtttaccacctgtgaactagaggaagtataaaaggtgatagaaacattattcagtcaaaccagagaagacaagaaataagagattaaagaaaaaaaggatggatagaacatgtagaatacaagtataagattctgtatttagactcaaatacagtctaagaatcacattaagcacaagtgaattaaatgctacagttaaaataccagcatagtaagactgggggaaagtgtagctatacgttgtttataagagatctacataaaagataaatataggggaggttgtgtgtagaaggatgaaaaaagacataccatgaaaaccgtaaccaaaagaaactgatgtagtcagtcaagtttccactggaaaaaacaagtctgtaggatgtatgtattgaaagattcaactattcacaatagcaaagacatggaatcaacctaaatgcccatcaatgatagagtgggtaaagaaaatatggtacatatactcaatgaactactatgcagccataaaaaagaatgagatcatgtcctttgcagggacatgaatggagctggaggccattatccttagcaaactgacacaggaacagaaaaccacataccacatgttgacacttctaagagggagc

SEQ ID NO: 33208 - DNA, 825 bp, Homo sapiens
tcttgatctcctgacctcgtgatctgccctcctcggcctcccaaagtgctgagattacaggcatgagccaccgcacccggctttgattagctgttttaacagacggtttctgctggcaatttcttctaaggctgaaaaggagtaggcccagaggccacagcaccaggtgtctgtgtcaccccctgttcagaactcttcacgactccccaaaataaggtttccatccatcatctttctgctcaaggctctctacatgatcttgtccatccagatttccccagatcaattcctcaccagtcaccaataccccatgtccatttccacagcttcctcttacaaatcccagtctccactattccagtgaaattgaagaaagcatttaatgaagaccaactattaaggaaaattcttaagagtagccatgaaaaataaaaagatagattacacttaaaagaccacagttagcagtggctcacgcctgtaatcccagcactttgggaggctgaggtgggtggatcactggaggtcaggagttcgagactggtctggccaacatggtgaaaccccatctctactaaaatacaaaaattagctcggtgtggtggcacttgcctgtaatcccaggtacttctgcaggttgaagcaggagaattgcttgaacctgggaggtggaggttgaagtgagctgagattgcatcactgcactccagcctgggcaacagagcgagactccaactcagaaaaagcaaaacaaaacaaacaaacaagcaaaaaaccacaattagactgacagctgacttttttaggagcaatattggaaggcta

SEQ ID NO: 33209 - DNA, 305 bp, Homo sapiens
actctaaccaacatctccttgtttcccctaccaccccttccccctactctctgataaccatcattctactctgattctgtgagtttgttttagattctacattaggaatcatgtgactttgtctgtctgtgcctggcttattccattcagcataacgtcctccagggaagcactttcttgtccacccccttcccctttttaaatagcagtctgttccatttggtggatgcagtatcttattactctaagaatatttctaatgttttcttttgtttcttgaattgtctgtgttgaatttttaaggc

SEQ ID NO: 33210 - DNA, 631 bp, Homo sapiens
aaacggatgaaagcgtcgaccccatcagcccttgcgctgggcccaggggaccctggcattcctggttcgagaccagggtgagcttcaggccgctaggggtacccaaaagcgggcagaaggcccatgaggggaaggtgacacacctggggcagagagaaaaaaaaacaacaaccgtgccgcggataagcggggcctgggtcccccacagaagaaactgtcttcccatcagcacttgcactgcgccccggggacactggtatccctggctcgagcccagcatgctcctcggcctgctaggggtaccccaagacagacagaaggcccatgagggaaaggtgagacacctggggcagagaagaaaataaaaaactgcgccgcccagaagtggggcctgggtcccccatggacgaacgtccctacccataagccctgcactgggccccggataccctagcatccctggctcaaaacaagggtgcgcctcgggccggctaggggtacatcaaggcgggcagaaagcccatgacgggaaagagaggcacctggggaaaaggaaaaaaaaaaaaaaagtcgacgcggccgcgaatttagtagtagtagtcgaaccggaatttcggaccgggacctgcag

SEQ ID NO: 33211 - DNA, 580 bp, Homo sapiens
agttcgacggagactctctgccccaggtgagcttcaggccgctaggggtacccaaaagcgggcagaaggcccatgaggggaaggtgacacacctggggcagagagaaaaaaaaacaacaaccgtgccgcggataagcggggcctgggtcccccacagaagaaactgtcttcccatcagcacttgcactgcgccccggggacactggtatccctggctcgagcccagcatgctcctcggcctgctaggggtaccccaagacagacagaaggcccatgagggaaaggtgagacacctggggcagagaagaaaataaaaaactgcgccgcccagaagtggggcctgggtcccccatggacgaacgtccctacccataagccctgcactgggccccggataccctagcatccctggctcaaaacaagggtgcgcctcgggccggctaggggtacatcaaggcgggcagaaagcccatgacgggaaagagaggcacctggggaaaaggaaaaaaaaaaaaaaagtcgacgcggccgcgaatttagtagtagtagtcgaaccggaatttcggaccgggacctgcag

SEQ ID NO: 33212 - DNA, 339 bp, Homo sapiens
ctaatgtgattaagaacctcctgaacatcttgtcttaatctagacgaacctgaggataacacagtaatcaggtctgctgaaacaggttatcctatatagctgtgtatttgcaaacttaggtcctgagttaggcttgatttgcccttagagctcgtttctattccagggaacatggggcattatgtcttagttgtaaaaatggttattatattaacaagacctctagatcttacggaagccaccttcttctctcagattattcatctccatttcttggtcttttgacattgattctaataaatttggggctcaaaacagctgcaaaagatgtatctgtta

SEQ ID NO: 33213 - DNA, 519 bp, Homo sapiens
gcatggtaactcatgcctataatcccaggactttgggaggctgaggcagcaggaatgcttgatcccaagagttcaagaccagcctgggcaacataacataaccccaactctactcaaaaaaaaaaaaaaaaatagcagagtggcagagtgtggtggcacacatctgtagtcccagctacccagaaggctaaggtgggaggatcacttgagcctgggaggtcaaggttgcagtgagctgtgactgcatcactgcacttcgacctcagggacagagcaagaccctcaaaaaataaaaattaaaaacatgtagcatcagttttggaactgggtactacacagaagcaggaaaaattatagaaagataatctggggaaagaacagtttattgtggtgaaataattggtaacatttttgcctgagattacttgaaagatggaaatgaacttatagatctggctaagaagatttctagacaggatgctgaaaatataatctggtttctacctatgataaaggcat

SEQ ID NO: 33214 - DNA, 336 bp, Homo sapiens
ggagttctggggcttttgttggtttaaaaccattttcagcctaggactaatcagatcctggaattgaaataattcattctccttgtcctaaacttttcttctggcttcagaagatatgatgtacaagtaatacagcgggaattggtggcgataagccatggttattaccttgactacaaacacgcctgctaagtgctaacactgaatcgtcactatctcaacaggattctttcccaaaagggaagaaaggtgtggcaaatataaatatttctaatttaattttctaagtcctcactctggcataacagaaaaatatacaaaatattgcaaagcaga

SEQ ID NO: 33215 - DNA, 309 bp, Homo sapiens
caactattttaaccagttattcctttacaagccttgataatcgcccgcactcgtgtgtgtttgagagtgtgtgtgtgtgtgtgtgtgtgtgtgagagagagagagaggatgttttctgagtgatcggaaactccttattgataaagcctttgagtcattttataaaaagccattgtgttgtttttttttaaaaaagtcttaatgatccttacatgagaactttattctttttatgtgctaattatttttccatatgatgagcatgcatttttttctaataaacgctcagcgatttgccctaggactaaa

SEQ ID NO: 33216 - DNA, 562 bp, Homo sapiens
gacaatgttgagagaatgagaaaacaagctacagactgggagaaaatatttgcaaaagactaataaaagactgttattcagaatatacaaaaaactcttgaaattcaacaagaaaatgaacaacttgattaaaaattgggaaaaagttctcacctcaacaaatacttcaccaaaagagatacactgactgcatgattgcaaataagcatatgaaaagatgctcaacatcatgcatcatgtgtcagtagggaattgcaaattaaaacgagatattgctacatgcctattagaatggccaaaatctaaaacactggcaataccaaatgatggagagaatgcagagcaagaagaactctcattcgctgctattgagaatgcataattggaagacagtttggcagtttcttataaaatgaaacaaactcttaccatacaatccagcaaaaacattctttgatatttacccaaagaggtgaaaacttacacccatacaaaaatgtcaacatcgatgttttagcagttttattcataactgctgaaacttggaaccaaccagtatgtc

SEQ ID NO: 33217 - DNA, 260 bp, Homo sapiens
tggggacggggtttcaccatgttgcccaggctggctttggactcctgggctcaagtgatcggcccgacacggcctctcaaagtgctgagatcacaagggtgagccaccacgcctggcccggggctagattttattacagaagcaccaggtcttcagaagcttcaaagaagatattgtacactaaacaattggttaagatagtaaattttatgttctacttttttaccaaaattaaacagctttaaaaattatcttaaaaa

SEQ ID NO: 33218 - DNA, 650 bp, Homo sapiens
acacataagctttggcaggtaagtaacatgatcatcactcgacagacatgctgccttaggcccaagtcacctggccaaggtccagcactcattgagcaccatgattctccatgttggacctctgcctcaaggattcatgaagaaacagagaaagtaaggggctgataaatgttcttgtgtactaaaattgcacatctggaaactgactctgaaagcggtgccatacctagaacataattagtgcaggtcaaaagcaaacccatcatcctgcgtgttgttccctctggcgcttcttcctgctccctggagccatgttggcattaaacaagacagcatgagtgggtatgtttaacacctcttgcagtattttggggttttcccctggggcctcccagaatctctgtgtgtgagagcaagccagggatgcttttgtgaaggtggcaaccccaactctaaggccagccgaaagagtactctctgtgcctctcaaattaccccagcttcctggccgtctgactcagccctgttgggcgtcagtctcatggaaagacacagtaatgggtggagacctacccattctttttgtttgtttgttctttgttttgagatggaatctagctctgtcgccaggctggagtgcagtggtgcga

SEQ ID NO: 33219 - DNA, 658 bp, Homo sapiens
aatcagttccaaaaaataagctcattaaaaggtgggggcgggggcacttaccctagatgccaggggattcttagaaccctagggaacctagggaaggaagtgctttgggccactcaggggctatggcagtaacaggaaagcccaagaacactcccaggcagagattctctctctctttctttctttcttccttcctttcttcctttctccttttctctctctctctctttctctcttttctgtctctctcttgtttctctgtctctctctctctctctgtgtctctctctctctttcttgttttttctcctgggggaaacgggagataagtggcctcttgggtcagattcactctgagcagcacattcattctttcattctctctttgctgactgtctttttcctatagactgagagagcacttagaggtagcttgcagcctccaccaaactagaccctcttcatctcaatttctcgttctaagaagaacacattgactgtctcagtttgtgtcgtgtgtccagctttgacaaagatgggagtaagtagtttgtagccccatagtacaagtatgacttggcatggagttgagaattacttagtgcttagaaaaaagggtcaacataggctagggagctcctgtaggataaagatatct

SEQ ID NO: 33220 - DNA, 453 bp, Homo sapiens
aatatcctgcctgcccatctgctgatatttgcagcaatcaaaagcagcaagaacagcagtcctctgccttatttccactttccaaattgtccatgagtgcacctaattggtggtacctaattcccatccagaactctagctgccatggagggaagcattttgtgcaatatggcgcaaattatgggtgcgttagtccccgccttaaccacggaggagacgttccaagacctccagtggatgcctgaaacctcggctagtaccgaactctgtatgtactatgtttttcttatgcttgcatacctttggtaaagtttaatttataagttaggtacactaagagattaacagtgttaactaataataaaattgaacagttaaaacaatatactgtcataaaagtaatgtgaatggactcaccacctctcccaaattatcttattttcaggtaactga

SEQ ID NO: 33221 - DNA, 385 bp, Homo sapiens
tgtaatctcagctacttgggaggctgaggcaggacaattgcttgaacctgggaggtggaggttgcagtgagccaagttcacgccactgcactccagcctgggcaacagagcgagactccgtctccaaaaggaaaaaaaaaaaaaagttaaatctcaagcttgcagggaggaaagcaatctaaaggacaatacctcaaaacaggtcaggaattgttctacagagggatgtgaatatgaatatgacgctaaaaataaaaggatgggacaaatgatttaaatatcctcccacatgccacaaaacgcagccaactgtcccctacccatccttgcatacacctggagtcttcttctctagactagaacagcacagcccaataaaatttct

SEQ ID NO: 33222 - DNA, 380 bp, Homo sapiens
caagaaagcactctactatcagatcaatcaaagattctgtgagtgaatttattggtttgcatggtgaagcaagcttagcatcaattaaaaggtaaataatttcttttctgaatggtaaagacaatcaaaatattactttctggaaaactccaataaccaaattctcaatgattagtgtatgtgagcaggaaaacatttttacagttgtagtatggggaaatataaatccaattttaagagagaaaattatgactgggtgtggaagggacagtatagtcagataccattgtcatggtggtttttactgggaacttcatgaaagacttttgtagcaaaccactgcagtattgcaaagcctccagaacatttggaacttgtct

SEQ ID NO: 33223 - DNA, 217 bp, Homo sapiens
gtctatatcttcacatcaaacctagacagaagcattctcagaaagttttctgcgatgactgcattcaactcacagagttgaacaatccttttgatggagcagttttgaaaccctctttctttggaatctgcaaggggatatgtggacctctttgaagatttcactggaaacgggatcatcttcacataagaactaaacagaagcattctcggaaact

SEQ ID NO: 33224 - DNA, 591 bp, Homo sapiens
catttaggtgaggaaactaagaatcagaggtcttaaaaccaactagagagaagctataactaagtttaatctgatttcaaaccctccgcttttcccaccacaccaagcaatgccatgttctacctaggtttcctgtagagggagtactaacagcaataatggtggaagttaaacagggttcatttgctgaagaagactcacaggaccccaagtgagagtgatcacaaatctgcagtttattgcagtaaaacagtacactatcacagcagcactgaagtaagggtgtcattacagccacaggctgcctgtctgggaaggccaggtccaacctcctatttcctgtctatataagggccatgagaggacatactctcccttgaatcaggaactactgatgtgtgcacagaacactttggaataagagagcccaaagtgtaatctcaactgggtttttaaaaatattttgttctttggccaggcacagttgctcccaaccataatcctaacactgggaggccaagacaggaggattgcttgagtttaggagtttgagaccagcctgagcaataaatatagtaagacctcatctct

SEQ ID NO: 33225 - DNA, 117 bp, Homo sapiens
cacaaaaaggaccagggcggaaattgttctatctggactttagctcttggtggaggagacatatcaagtgttcttaagtcaactgtaatactttttttgtattatgaattcacacta

SEQ ID NO: 33226 - DNA, 382 bp, Homo sapiens
tggaccaccatgccagttttcccaggacagagggatatccgtatgtgggacttttagtgccaaaagcaggaaagtccggggcaaaccaggacaagttagttaccctacccatgaccattatacaagttaatgaacactgtgcccttagggttcatctaagactcaaccctttgggttcatctaattatttttcaaccttttgttcattatcatattttgagactttttttcccttaattgtctactccccagtggaatgtttttttgagagggagtctcactctgtcgcccaggctggagtgcagtggtgtgatctctgctcactgtggcctctgcctcctgggttcaagtgattcttgtgcttcagcctcctgagtaactg

SEQ ID NO: 33227 - DNA, 3096 bp, Homo sapiens
  misc_feature (1382)..(1382): n is a, c, g, or t
  misc_feature (1642)..(1642): n is a, c, g, or t
ctcggccgccgtaggccggcttggaggctgggggagggcccagaagtggaataattcaggaaagtgcaggttctgggaagtctcggtgggttccccgcaaaatcaggcttgagtgcagtggcgcaatcgtggctcactgcagcctccatctcccggggctcaggtgattttcccacctcagctttcccgagtagctgggactacagagatggcatctcactatgttgcccaggctgatcttgaactcctgacctcaagtgatcctctctccttggcctcctaaagtgctgggattccaggtgtgagccacttcacccagccacatttatccatcttgtaaaatattgctttgttttttggtgcatttcaaagaatcactgaccctggaggatgtggctgtggagttcacttgggaggagtggcagctcctcggccctgctcagaaggacctgtaccgagacgtgatgttggagaactatagcaacctcgtgtcagtggggtatcaagccagcaaaccagatgcactcttcaagttggaacaaggagagccatggacagtagaaaatgaaatccacagccaaatctgtccagaaatcaagaaagttgacaatcatctacagatgcactcacaaaagcaaagatgtctgaagagagtggaacaatgccataaacataatgcatttggaaacatcattcatcagaggaaaagtgattttcctttaaggcaaaatcatgatacatttgacttacatgggaaaatactgaaatcaaatttaagtttagtcaaccagaacaaaaggtatgaaatcaagaattctgtgggggttaatggagatgggaaatccttccttcatgccaagcatgaacaatttcataatgaaatgaacttccccgaaggtggaaattctgtgaatacaaattcacaattcattaagcatcagcgaactcaaaacatagataaaccccatgtatgcactgagtgtgggaaggctttcctcaagaagtctcgcctcatctatcatcagagagttcacactggggagaaacctcatggatgcagtatatgtgggaaagccttctccagaaagtccgggctcactgaacaccagagaaaccacacaggagagaaaccctatgaatgcactgaatgtgacaaagcattccgctggaaatcacagctcaatgcacaccagaaaattcatacaggagagaagtcatatatatgcagtgattgtggaaaaggcttcatcaagaagtctcggctcattaatcatcagagagttcatacaggagagaaaccacatggatgcagcctgtgtgggaaggccttctccaaaaggtccaggctcactgaacaccagagaactcatacaggagagaanccctatgaatgcactgaatgtgacaaagcattccgctggaaatcacagctcaatgcacatcagaaagctcacacaggagagaagtcatatatatgccgtgattgtggaaaaggcttcattcagaagggaaatctcattgtacatcagcgaattcatactggagaaaaaccctatatatgcaatgaatgtggaaaaggcttcatccaaaagggcaacctccttattcatcgacgtactcacactggagagaaaccctatgnatgcaatgaatgtgggaaaggcttcagccagaagacatgtttaatatcccatcagagatttcacacaggaaagacaccctttgtatgtactgagtgtggaaaatcctgctcacacaagtcaggtctcattaaccaccagagaattcacacaggagagaaaccctatacatgcagtgactgtgggaaagctttcagagataaatcatgtctcaacagacatcggagaactcatacaggggagagaccgtatggatgctctgattgtgggaaagctttctcccacttgtcatgccttgtttatcataagggaatgctgcatgcaagagagaaatgtgtaggttcagtcaaattggaaaatccttgctcagagagtcatagcttatcacatacacgtgatctcatacaggataaagactctgttaacatggtgactctgcagatgccttctgtggcagctcagacctcattaactaacagtgcgttccaagcagagagcaaagtagccattgtgagccagcctgttgccagaagttcagtctcagcagatagtagaatttgcacagaataaaaaccatatgaatgcagtgaatgtggtagtgctttcagtgatcaattacatcatatgtcacaaaaaacacagaggaacaaactgatatattcaaggtggaaagcccttgaataaaaccttatggctaataagcatatactcagagaaaaatagtatgaagtggagactgggaaattcttttatgggaagatagatcttctcatcagtgaccatagatcacatcttcagtgagcttatagttggtagaaatataatgatcatggaaaagtccttgttcagaaacagtacgccagtaggtatcagggggtttacacaggagagaaacttttggaagacctttgaaggctatgaatgtggcagggttgctagtggtacattctgccttatcctcagagggaatcatatagaaataaaactatgaaaatgtaactagaacatcttcatcaaaatatgaaagaacacacgaagcaaataagccctgtgaaaaggagtattttagagatttcgatcagaaatctaacatcattatatggcagataatatacaggatgtgtattttaggacaatataccttgaatcactagttgatatgtcaatgactaattaaaaggggttgtcagtgttacacatcattggttaaatttatagcacaatgtacctcttcccccttttttgataagagtcttctattcccaaccaagatcattatatgattagctcttgtgtttctttgattccaaatttcttcacttgttatttcagactactgaagctcttcaaaaggaaaaatgtatttaatttaataatgtaacacaacaagtttggatgtgtttaactttataaataatcaccccagaggaatgaagttcaaaacttgtgaataacc

SEQ ID NO: 33228 - DNA, 490 bp, Homo sapiens
tgtgggcgtccgtttagtgcggagccgtggagtttgtgggggaagcgggagcaagtgggagtcggggtattggggttggggcgtctccggagtcagccctgagggatcccagtggtcggtggtcagagtctgtccagagcaacacttggaagtccgtgatcagggtttggtgcctttgcgggtcactctgtagggctcggtgattgaggactggagtgaggagtggtttttgtcaaggaaaactgtgtctgcttcggattcggggttttattttttatttttgagacagggtctcgctctgtcacacaggcttgagtgcagtggcgcaatcgtggctcactgcagcctccatctcccggggctcaggtgattttcccacctcagctttcccgagtagctgggactacaggtgagcgccaccacgctatctatctatctatctatctatctaatctgtctaatctaatctatctatctatctatctatcta

SEQ ID NO: 33229 - DNA, 626 bp, Homo sapiens
ttcctatgaggatcccccctctagcacttccttactgagactattacaaatagatagagatatgagggtgtcctccctaattcattctatgaagccagtatcaccctaataccctataccagaatgaatataaccaagaaaaaaaagggagtcaaaactaccgaccattttccctgacgaacggaaatttaaaattcctcagccgggcccgaattaacgcatgtcaggtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaa

SEQ ID NO: 33230 - DNA, 288 bp, Homo sapiens
tcaatttatttatttatttatttttgctccctttctctacctctatttctgggactccaactagatgtatattagacatcttgctactgtcccacatgtaaatgagtctcttcatttttcattctttatctctcttgtcttcagattgtataatttctattagtctgtctccaagttcactaactcttctgttattccaatctgtttttaagcccatctatttttttattttctatttgaggtaccctatttttatttgagtaccatatttttcaattctagaattct

SEQ ID NO: 33231 - DNA, 340 bp, Homo sapiens
ctgcattgtccctgttcccatgttctcaaccccttatgggatgctgatgatttcttcctgattctttatcattctaccttcccgaactgatatataatatctccacgttcccagctagagaacagttgatcttctaattctgtatcccagttcatttgctaactccattctaccacaggtagcctgcctaagcctatgagcactttgagttccaaaagccataggtttagtgtatgaattattcaagttttggcagaatttttaaaatttctagagtcaagcattacggtgtaaattcaacatgatggaaatttggttgatggctttgaaggtgatgaga

SEQ ID NO: 33232 - DNA, 2408 bp, Homo sapiens
gagggaatcagaattgtgtttcaagagcgtcactatacggttaggatggaagacagattagaggaaatgcgagtggataaggcaagatgcatttggaagacagtcaagagtttaaccagaaagagaagacatgtcagtaattgccatcatgggaagcagtgagaagcaccagaattgagaaaccaagtactttaagagttagaggagggagacacaccctgtctagctgaggttcatggaagagttggtattcaactgggagggattttatcagtagaggagctgagattgagaatggggttgaggaagagataagtcaggagcaaaaatacggaagtgagggagcctgtgactgaagagcaacatgtagatcaatttgatgaaagcactaggtaggggccagcaaatactggtttgcttctgttttccagagaacctcgaggagacaaggtagaaaaccaatcccaaatgaacaggagtactactgagacctgtactgaataagacaagagaaactcagtgagctaaactagggtataagccacttgcaggagcagagcagggtcaggcattggtctgacttgctgtgaagactttaagctgtgaactcataggacttggattccacttgtcagggagtttgattggttcagaatctggggcaggatggaacctgcaggaaaaagctgactggccccgtgtgagacaggtgacactggaggaatgaagaataggcaccctcagaggtttaggctggaggcttggtgagaatatcaaccctgacccatagagctactgaaatgtatgatactacagtgagcgccaaggataccttcccagccaaacatgccaaggaatagtctggggatggctagtgaaccaagcttcacaggtagccccagttcttcatgagagacacacttgagttgctggcaataatattcttactgtccaaggttaagtggccctatgtctcacaaggccccattcagggcttatcaagctttttgaatattccatcaagttagtctgaaactctagagtatttactttatatgttctgaacttaacagggcacattctgtctctaatatcttggttctgagtacccatcctcactaggacactagtgccatcttgctagctggtccatgagttacataatgatggagcatctcatatgtgtagttctgtaacagtgaccaagcagtggacattcctatccattcaaggctgaacatgtgatggagcaaggcatgtctgcacagggcctagcatgaaggggttgaacccttataacttggaaactaactgaatgggagaaatgagatggaataaggcactgacgttggtgcaatttctgattatattttgttgccatttaacttgtttttagtgtatgccacaccctgtggtaactcgtttcatctgcacagtgacccttgaaatgcccacagtaaagacgagaaaactgaactccttagaattgacgtatcttgcccaaggtcatacaatgagtgaatggggcaacctggacatggacttcagtcttcctgagctcagagctgaccaaagactctgtctaaacttccaagacccttttctcccattggttgatgcacatggtattgaaaaatgtcgagcattctctttctctgttgaaaagttctgcctcccattagttatgaagggaatcctacagaaaggggtgagtcccttaaattcttcaattgattatgggaggttagcaaaaaaaagagagtttatgaacccatgaaaccttaggttctatctatcagctgtgtcttactgaaatcacctcttgaaccaggacccttcagacatagcaattcatgtcctcagtctctggacacaatggaatcctcattataaggccttccacacaaagataataatagtggtgcctctcccatgtgtgttcacatttttgagaaaaaatattcttgcagctatcaaagcacctgctaatcaaagatttcgtattccctgtaatttgtttttaatcttgtaaagccgactactttcaaataggactcagagtgtcaaaggctgaaattcatttccttgaacttcatttaaactgggccacagaatcattctgagagaatcatttaaattaatatgtggcattacggtgttaaaaagaaaaaaattttgtcctaattcccaatttcagagtttctccagacctccaatctgggctctgaccccataattgtgtgcagctgagctgctgacaagtccacacatattctgaagtcacattttctggctctggggctccaaggactcacaaagaggaggaatttttttttttttaatccctgcttgttccgtcaactagttcaccggttaaaccctgattgaatgtagaaattttagaaatg

SEQ ID NO: 33233 - DNA, 790 bp, Homo sapiens
acaggtactgagccgtgtgtatccttcaggtccaagcagcttctaaactgtgtctatctctgttcaggtccctggaactctcctgggcagcaagctcacaagagaccgacctctgtggccttcgaagcgggttgctgttagacacaccttttagaagctacattcatagtatctcaaaagacagacataaggggtactcggtatggccaccactcactcccacaacacagccaccatttcccacccagaatttcctgtgaaatgtgctcattttaaaacagcacacatcctgagaattgcaaagttgggcatagagatcaatacaaattagacttctttttagatacgctctacgctctgcagagccctctggggtctccaagggctgggacctgctggataaaactggatgaaactaagttgctgcttctttggtgcccttgaatggactttcttggctgcagtgacgttaggtccgcttcctagccgcgtgctgctctgccatcggggatgctaaagtcggggagggccaggaagcctttctttgtttggaagtttttgtttctccttcgcctgctaggttgggataatccgttgggaagtctctgagcgtctttaaacataaaatctagtttcaaaggtttaaattcccaagttgccccctaagttacatgttgcttaggcttggttgctatctgtatggtataaataattccatttagaaattaagaaattatgggctgcatttttgatgccagtggctctgtagtatcccccaaccaccaaaaaa

SEQ ID NO: 33234 - DNA, 3659 bp, Homo sapiens
ggagcccctcagcggcggcggggtctgtgagttggtcgcggggtcttggcggggaatggaggtagaataaacgtgggacccggagtgcaccaaggtgagaaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggacgagactgatgagttttttgaagagtgcattactgatcctttactccgagaacatctttctgttctatcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctacgattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccagggtaaggggatagcacatttggaagctattgttttttcctaaataaatctctactgtatctatttcttaggaaagtcccttgacatttatctgaggaaggatatggtttctcaaggattgtgtacaatcctgagttaccatagtagcatccgttgctttcggggtgcagctctgctcagtcttcaatttgtttctgtagctactgtgaacccaatcttaaaggaggttctcatgcccagggtccacagtgaccagccagcaagtctctggtagaaaaacacccagtttttagccaaagcaaattctcctattaacacttagcaggatgaatttaatattcattcaaaaagggtgtttatatcgacactctgggctgcctctcctattcaggtattgggacatccctgttcctttctttccagcctgactgcaactcacatttcaaaacatcttctttttatgcattaataaaagagccacatttatcttcaaaaaaaaaa

SEQ ID NO: 33235 - DNA, 363 bp, Homo sapiens
cagatagtgaaagagaagctggtgtgccacgccatcatcggggcacagaaggggaagagcttggtgatggctgtgaacatcacctgtgagttcgtcgcacctctcatccagctctccaccaagcagctcatctaccgactggagaagaaacctaacagtatcctgaaacctgattaccagcccttggccgtaaagaacatttccaccctgcccgtgaacttgttgctgtcaacatctggacccttctttatatgtgagactgataaatccctgctgccggcaactcctgagcctattaaactggaaattgatgaagaaaaaaacctgctgatcaagtttgacccttcctacagaaacgatctg

SEQ ID NO: 33236 - DNA, 428 bp, Homo sapiens
cagcaaatgttcaggaatcctatgtgagggacaaacattcagagcctcggagcagtgttctggaatcctatgtgaaggaccaactcagtgtgctggcgctcttaattacagcaaggtattgctccccagcttgctcttctcctgagtcgcccccgagcctccagtaatgggctgcctcccagaaggcagctggcctgccaacccaagcacactgagtttgtcctgccttcctgggaagggaagttgaatctgacattcaaatgacaaagcagcaaatgtttctaaagcacctttggtggagataagaagaagtgtgtgtgttttgtagagtttaggcagagaatcctaagaatagtgaagaaacgggtcagaccctctctaacgggtttgactttcaaagtatgtaaccagaaaggttttagcaggaa

SEQ ID NO: 33237 - DNA, 3607 bp, Homo sapiens
agctcgggcggcgcatggagagtgcgggcggcttcaagctgggtgagaaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggacgagactgatgagttttttgaagagtgcattactgatcctttactccgagaacatctttctgttctatcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctacgattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccagggtaaggggatagcacatttggaagctattgttttttcctaaataaatctctactgtatctatttcttaggaaagtcccttgacatttatctgaggaaggatatggtttctcaaggattgtgtacaatcctgagttaccatagtagcatccgttgctttcggggtgcagctctgctcagtcttcaatttgtttctgtagctactgtgaacccaatcttaaaggaggttctcatgcccagggtccacagtgaccagccagcaagtctctggtagaaaaacacccagtttttagccaaagcaaattctcctattaacacttagcaggatgaatttaatattcattcaaaaagggtgtttatatcgacactctgggctgcctctcctattcaggtattgggacatccctgttcctttctttccagcctgactgcaactcacatttcaaaacatcttctttttatgcattaataaaagagccacatttatcttcaaaaaaaaaa

SEQ ID NO: 33238 - DNA, 3732 bp, Homo sapiens
agctcgggcggcgcatggagagtgcgggcggcttcaagctgggtgagaaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaattgagaagactgaagttcagacctgaccaaggtcacacgtctagtaagtagttgatggatttcagtctgtgtttaactctgctttttcacatgcacgatgttcatcatcatgtgtttccctgcagattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggacgagactgatgagttttttgaagagtgcattactgatcctttactccgagaacatctttctgttctatcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctacgattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccagggtaaggggatagcacatttggaagctattgttttttcctaaataaatctctactgtatctatttcttaggaaagtcccttgacatttatctgaggaaggatatggtttctcaaggattgtgtacaatcctgagttaccatagtagcatccgttgctttcggggtgcagctctgctcagtcttcaatttgtttctgtagctactgtgaacccaatcttaaaggaggttctcatgcccagggtccacagtgaccagccagcaagtctctggtagaaaaacacccagtttttagccaaagcaaattctcctattaacacttagcaggatgaatttaatattcattcaaaaagggtgtttatatcgacactctgggctgcctctcctattcaggtattgggacatccctgttcctttctttccagcctgactgcaactcacatttcaaaacatcttctttttatgcattaataaaagagccacatttatcttcaaaaaaaaaa

SEQ ID NO: 33239 - DNA, 3408 bp, Homo sapiens
agctcgggcggcgcatggagagtgcgggcggcttcaagctgggtgagaaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaagggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggacgagactgatgagttttttgaagagtgcattactgatcctttactccgagaacatctttctgttctatcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctacgattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccagggtaaggggatagcacatttggaagctattgttttttcctaaataaatctctactgtatctatttcttaggaaagtcccttgacatttatctgaggaaggatatggtttctcaaggattgtgtacaatcctgagttaccatagtagcatccgttgctttcggggtgcagctctgctcagtcttcaatttgtttctgtagctactgtgaacccaatcttaaaggaggttctcatgcccagggtccacagtgaccagccagcaagtctctggtagaaaaacacccagtttttagccaaagcaaattctcctattaacacttagcaggatgaatttaatattcattcaaaaagggtgtttatatcgacactctgggctgcctctcctattcaggtattgggacatccctgttcctttctttccagcctgactgcaactcacatttcaaaacatcttctttttatgcattaataaaagagccacatttatcttcaaaaaaaaaa

SEQ ID NO: 33240 - DNA, 1568 bp, Homo sapiens
aagatccatagagccaagaggtccctgccccgggacactgttgctgtgacttgaatttcaggctaggagtgggcccccaagatgaggctcatctttaacaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccagggtaaggggatagcacatttggaagctattgttttttcctaaataaatctctactgtatctatttcttaggaaagtcccttgacatttatctgaggaaggatatggtttctcaaggattgtgtacaatcctgagttaccatagtagcatccgttgctttcggggtgcagctctgctcagtcttcaatttgtttctgtagctactgtgaacccaatcttaaaggaggttctcatgcccagggtccacagtgaccagccagcaagtctctggtagaaaaacacccagtttttagccaaagcaaattctcctattaacacttagcaggatgaatttaatattcattcaaaaagggtgtttatatcgacactctgggctgcctctcctattcaggtattgggacatccctgttcctttctttccagcctgactgcaactcacatttcaaaacatcttctttttatgcattaataaaagagccacatttatcttcaaaaaaaaaa

SEQ ID NO: 33241 - DNA, 1732 bp, Homo sapiens
agctcgggcggcgcatggagagtgcgggcggcttcaagctgggtgagaaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatataggtggatggctccatttgttccaggccaagtgtggacatgggagtatttcctctagctctcaagaccatggctcttagtttttaatctcctcagcattcagttggcacctcttgtgggtgctgaagggagcagattacaggccttgagtacttgaagatgagggactattactcattcaaccctgctgcactggagacacacatcttccccattgactgttaaaggtgttggtagctactagaccatttgtaaaatgggttaagcccatggttttactgaagagagggctggcctgctgttatgctgtctgatgaaaggtctcctcatctataaaagagaaccacctctgagtgcaagaaaccatgactatcaacaggacgagatggcaaaacactaggactgagatctatggaagcccttgttggagccaggccacatgaagttgtggctatacacctcctccttagactctcagtcctggctccaattctccatcagaggaagaatccagtaccctctctcctccctttgccttctactggctgttaccgatttggagtttcaacagcatgggagaagaccagcgttttcgaatttgttttgttctctttgttttctggtac

SEQ ID NO: 33242 - DNA, 2454 bp, Homo sapiens
agctcgggcggcgcatggagagtgcgggcggcttcaagctgggtgagaaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggacgagactgatgagttttttgaagagtgcattactgatcctttactccgagaacatctttctgttctatcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctacgattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtattgctccccagcttgctcttctcctgagtcgcccccgagcctccagtaatgggctgcctcccagaaggcagctggcctgccaacccaagcacactgagtttgtcctgccttcctgggaagggaagttgaatctgacattcaaatgacaaagcagcaaatgtttctaaagcacctttggtggagataagaagaagtgtgtgtgttttgtagagtttaggcagagaatcctaagaatagtgaagaaacgggtcagaccctctctaacgggtttgactttcaaagtatgtaaccagaaaggttttagcaggaa

SEQ ID NO: 33243 - DNA, 443 bp, Homo sapiens
cttctttatatgtgagactgataaatccctgctgccggcaactcctgaggtaccttaatagggggctgttctggcaagctgtctggggtggggtggggtgtgataaaggaagagaagagtaatgatacaccacccaacttcagctcagaaagatgtaaaggatccaggaagcaaacagggaagactacagaaaatttaaaatgagtggtaaatcagatggagaaactgaggcccagtattttgcccaaggtctcacagctagtaagtggcagaaccaggatttggacctaactactctggctccagagcctttaatcttaggaattaatatcccttgtatacgaaacatttcttcaagtcttttttgagaaaaaattcaaatatggtgttttttagaaaataatgtagtctaattccatttttgtaaaatcctattattcctc

SEQ ID NO: 33244 - DNA, 377 bp, Homo sapiens
gggaagctgtccaaagagaacaccatccctgccctatagcaagcttcttctctacccagggtgggcccccagttcaatgtggcatggcagaacaggccagggagactggaggacctgggaaagtgttgtggaaggggtggattttagctgaggcttcacctcatggatgtggaggtcaggagccttcagggtgcaagtgggggccctgcacaaaggcttttagacaagagcagtcagggcagcactgagtatacctgtatagggccgagggtggaggatggtgggaatcacagaggggacagggagagcaggctggcaccccagcttccaggggcctcccaacaccgtgacccctaggcttcttcagccctccccga

SEQ ID NO: 33245 - DNA, 311 bp, Homo sapiens
attgagtacttaaccaaataagatatacagatagcaaataagcacatgaaaagatgctcaacctcattagtcattagggaaatacaaattaaaaccataacgaagtaccactacatacctattagactggctttagaagaaaaacggacaataccaagcgctgacaaagatgttggacagctgagatgctcctcatactttgctggcgggaatgcaaaatgtttgagtcactttgggagagcttggcattttcttattaaggtaaacatacccttacctatgacccagtaatcctactcctaggtctttac

SEQ ID NO: 33246 - DNA, 473 bp, Homo sapiens
agaaccctttgcctaccagcccccagcatgctgtgacgatcctgccccagtattggacacctgaggaggcgttccctctcctattcctccaactggctcttgtcctgctctcatcccaccttttctttgaagtctcctgccactctatcccactgtcaccttgcccttcttcacctcctgtatcttcctgtctatgttactacctaggcagagctctctagcttctgaaggttcatggatcatagaatcccagggccaagagggccctggacatcctatgtgtttcaaaggtcttccaagctcagagggagaagttgagttccctacgtgatacttcagggccataggtggtagaactgggaagcggttcaggatgtgactccaaacgagaatggcatgagacgcttaggcttctacagctccttcctcactctacgcagccaggtgattgtctgctctgccagggcactggg

SEQ ID NO: 33247 - DNA, 463 bp, Homo sapiens
ctaaaggagtagagtttagctgctcttgacacacaaaaagggggctagctgtgtaaattgatagatatgttaatttgctttacgacagaaaagcattttatgatatatatgtatctcataatataatgctgtaaatcttaaatatgcacaataaaatattttttaaaaaacccaacaaaaaagttgaaagttaaagaatggcaaagtatataccatgtaaatactagtccaaaaagtttgtgtaaccactctaatatcagactctaaagcttgaaacatttatagagataaagaagaacatttcataatgataaataagacaactgaatagaaagatgtcacatttccaaaaatgtatgcatctaataacatagctttcaaaatatttaaaacaagaactgacagaactaaaagacaaattcaaaatcacagaaactttaggatatttatctcaatacacgat

SEQ ID NO: 33248 - DNA, 524 bp, Homo sapiens
aacctatcattgatttatagttcattgcagttgttttgaagatgttcagagcactagcctactcatctgggaattagtaactgtgaactcgaaataacggaataattggacattcaggagctctgaattctaagtccagccatagttcttggtgggctcatccttaacaagccatcatttttctctgtgtctgatattcttccctgtaaaatgtatatgatctttcaggttttcactgcaaaagtctgtaagaacatattgcaagacagtgtgtgaatatgagaaaacgacccttaaccccaatagctaaagggaggattaggaactctgtaaatagagattgctaaatatttggaatcaactacagtctgctgccattgggtttgactggtaatgaccagtcccctacccagaggccctacaagagtggaatgctgaggtggagagggtcctcatcctgcttcctccttgtgacactctgaaccagtcagttgcccaagtaccatcagtgtctcctaatgaag

SEQ ID NO: 33249 - DNA, 1503 bp, Homo sapiens
actaagcctatagttacatttagaagatttagtaccaaaatcaaacttttagtaacaaacaggaatcttgtcaacacaatgtaggccagggattttgtaaaggtttctcaaagacccaaataagggagaaaaaaattttagttgggctgtttaacttgggaaacactgtcatcagcttgagggtcctcagccagcatgtgattattttgatgacaggactcaggctaccctttaaggcacattttttactcagcattaaacactagctacagtcgtgaagcagagctcccattgcagctacatacttgagatgtactcttggtttcagaatcgtaactaagaggtaaggcattggagaaggacaatgtaaaagacagaggtttagaacaaagtttatggtgtgaatgaggctttcaaaatcagtatctgggtaaattgatactaaagacactgaagaaacactcatccacataagatggaaaggatgtctgtccatctaacaagctcaggggtttctgagtctcagaatgacatcccatttcaaaaagaagaaaagagatattgaaatcattctgcctgtttgagagatgactggttatttacagcacaaaaaaaggcttagaatgaaaactagaagaggccttttgtttttcactcccagtgaggagagtagaaatcttaagatgctctactgggctacctgtagcactgactggagtttgctgcctacagagttttgaatgtactagtccttagtttccatagaactgaatgcacctctttagtaagttgctgatttatggtgctaaagaaaatgattattcccatttttttcttcttccccaagccccttaagcatttaagaaaatttaaaataaaagcgttagaggccctttttatgaatgtaacctaagtttctgtttgacatatgacactgcaacttaaaaatgttaggaaattatttgcctttttttttcttttagagttaagctttataaataatctgtagaatcaattgaagtttaaagcttaaggatcactcttaagacgtctacaaaatcttgtatatttttaagtgtgccaatttgtaacatattttgtaagtgtatatttttcttagaaaagtgctgtgaagtgtctgtatgtgagagttttcctttttctgcaccactaggtgctaataaaaggatatttacttcaaagtttctggttttagaaaccacaatacaaagaaaaaaaatacacttttgttggaaattttgtaacacaaaacatgttgtgaaagagtgtagtgatcttgtgcaaaaaaaatgaacatttgtgagcttcttgctgttttatagattttcttgtaaattattcttgtaacacttctggttttgttgttcttgttgcgaaggtttcaaatatttgtgactgaatgtacggtgaaactgtcataatgttacctagctgagttttgttattgtttatgaaataaataaaaagaaaagtttaaaatac

SEQ ID NO: 33250 - DNA, 505 bp, Homo sapiens
ttaaacctttctcccacaaatgaagtttatgtaagttatatcttattaaggctgtttaaaataataaagtttagaccaataacaaaactaagagtaatttgaggatggtagttaacttagtttcacatatttaagacttcccttacattactctctgtgtggaaattcctaaggggttactaacttccaaaacatatctgatgaccatctgattacagagttaaactttgtgctaatgtgctaaccattgctcggatctaagtaagtgtcatagtacagcagctgatagtgtggcacctgaacattacatcttcaagagaagaaaactgtatattgattgattgtgatatttattgggtcataatgtatttaaattttctttaatgcatatgttagtgattgtttactgtgataaagtgcaaagaggtcttcaagagtgatcctgcagaggaagaattacctcatgtcactggtcacttctcaattaaaagttccattagcaaat

SEQ ID NO: 33251 - DNA, 407 bp, Homo sapiens
ttaaatttgaaaatgcttttattcttttgtgagaatcagattaactctgatgcaaatttgcttttatgaaaatttaaaatatggtccaatccactggcaaatgcatctgtaatacagatatgataggatgcaagttccacccccagggacagcaattatatgcacttagcttaggtggttggtatatttgcttcctttcttcccacttagttttttgccttaaaagctttcttgtgcgcgcctctcatcgcaaactgcccttgaatcctgcctttgatgtgagaacaggactaactgggcgttaaatcggcattttctacatcaggtctccagcctgctcttgacctgactccaacacacaaagcagcgggcattttgttgtctggtcattttctgtaagtgttacc

SEQ ID NO: 33252 - DNA, 294 bp, Homo sapiens
gttttggctgtagctttcacttgtctgggtgacttttcacctgctgcctagggaattgttttgtgtttagtagattaatagatgggcagctctttggggtccttccatcttctccatgcttcagacctttacaccttcctctagtccttcgtgagtactaagggactaactttgaattcagctactcaggaggctgagacaggagaatttcgtgaacccaggaggcggaggttgcagtgagccgagacagcaccactgcactccagcctgggcgacagtgagactcttgtctca

SEQ ID NO: 33253 - DNA, 1372 bp, Homo sapiens
  misc_feature (23)..(23): n is a, c, g, or t
tctacccttccagccctgttccncgctcccatggggtatcgatgtgaagtgaccagcatgtcactggccaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactgaagttctgtccctgctctgctgctttcgcccctgctgaccctcgtcagggtcacccccgtcccaaggccaccggacttctaactccagcccctcctgggggcttcgttctctgatctggggtctgagtcatctcctcctagagtgggtcacgaacctgatggggctcagaactgaccccctctctcccccgaggtgggtgggcaccgtggcgtctcttctgccctgccctaaatctcccactctctgtttctgtctgtttcctactgctgctctctcaacctcattcccacctctggggccccttcctcgtgcttctccttcctgagggtttgggaaggtcctggggcagactctggggctcccatggggtggaaggagcctgttccagcacccttctcccagctgcattcccacgggtggccctggagctggtgagctttgtctgggcgttgtcttcggctggcattgctcctcccagctctggcccctctgctccctcaggaagcagtcccctcgtctccctttctgggcagcttccttgaggacagaaacttgaaaacaaacacaaaccaaagtttctggccatctgtggctggagggttctgaatgtcctctctccatgtcaggcagagggtcagcccccatgcttctgcctcaggccccaccccaccccaccccaggcctgcccctcacctcagggccatacccacagcgccctgatggaggaaccagaccgcaggctgtgccaccattaaacaagagcggctgtggccccatgctgtgcttcttggggtggcagggaaggtggggtcagcgctttttctcctctcaggtttgggttctgcgccatcccccatgcagcctcctgtgcagccctctgtctgtccttctgtccattcattcatctgccaacatactcacccatcatccatctgcacagccttccacccacccatccgtcttccatcatccatccatccatctacctatccatttatcatccatccactcacccatccaaccacccatccaaccattcagccatctccatctgtccattttctttcttcttcttttttttttgtttttgttttttctgagtgggagtttcactccagcctgggagagagagtgagactctctgtctcaaaaaaaa

SEQ ID NO: 33254 - DNA, 1499 bp, Homo sapiens
accccgcgtcgcgaactggaaaatatgcatagcggtgcattcgggcaaccctgccacccccagtagcagggccaccagccatttaaaggcagactgaatcagggtgtgctaacttatacctgcaatcccagtgcttgagcagggggaccgaggtggggggggtatcgatgtgaaggtgaccagcatgtcactggccaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactgaagttctgtccctgctctgctgctttcgcccctgctgaccctcgtcagggtcacccccgtcccaaggccaccggacttctaactccagcccctcctgggggcttcgttctctgatctggggtctgagtcatctcctcctagagtgggtcacgaacctgatggggctcagaactgaccccctctctcccccgaggtgggtgggcaccgtggcgtctcttctgccctgccctaaatctcccactctctgtttctgtctgtttcctactgctgctctctcaacctcattcccacctctggggccccttcctcgtgcttctccttcctgagggtttgggaaggtcctggggcagactctggggctcccatggggtggaaggagcctgttccagcacccttctcccagctgcattcccacgggtggccctggagctggtgagctttgtctgggcgttgtcttcggctggcattgctcctcccagctctggcccctctgctccctcaggaagcagtcccctcgtctccctttctgggcagcttccttgaggacagaaacttgaaaacaaacacaaaccaaagtttctggccatctgtggctggagggttctgaatgtcctctctccatgtcaggcagagggtcagcccccatgcttctgcctcaggccccaccccaccccaccccaggcctgcccctcacctcagggccatacccacagcgccctgatggaggaaccagaccgcaggctgtgccaccattaaacaagagcggctgtggccccatgctgtgcttcttggggtggcagggaaggtggggtcagcgctttttctcctctcaggtttgggttctgcgccatcccccatgcagcctcctgtgcagccctctgtctgtccttctgtccattcattcatctgccaacatactcacccatcatccatctgcacagccttccacccacccatccgtcttccatcatccatccatccatctacctatccatttatcatccatccactcacccatccaaccacccatccaaccattcagccatctccatctgtccattttctttcttcttcttttttttttgtttttgttttttctgagtgggagtttcactccagcctgggagagagagtgagactctctgtctcaaaaaaaa

SEQ ID NO: 33255 - DNA, 695 bp, Homo sapiens
accccgcgtcgcgaactggaaaatatgcatagcggtgcattcgggcaaccctgccacccccagtagcagggccaccagccatttaaaggcagactgaatcagggtgtgctaacttatacctgcaatcccagtgcttgagcagggggaccgaggtggggggggtatcgatgtgaaggtgaccagcatgtcactggccaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactgaagttctgtccctgctctgctgctttcgcccctgctgaccctcgtcagggtcacccccgtcccaaggccaccggacttctaactccagcccctcctgggggcttcgttctctgatctggggtctgagtcatctcctcctagagtgggtcacgaacctgatggggctcagaactgaccccctctctcccccgaggtgggtgggcaccgtggcgtctcttctgccctgccctaaatctcccactctctgtttctgtctgtttcctactgctgctctctcaacctcattcccacctctggggccattaccacgagctagctctcggtcgttttacactcaggaatcagctatccca

SEQ ID NO: 33256 - DNA, 541 bp, Homo sapiens
tttctgaggcttgaaaccaagagagtttagaagccaacctgtaattaaatagccatgtggaaaaccatgctggaaaaggcaaccccatgggggagttcaaactgaaaggaaaaacagtgaaggtataagatgtgagccttcttgtatcccttctgtggaatgtcacatcacagtagaggaggattccagctgaagagtgggtcatttgtgtgcaggcccctggaatggggcagcaatgtttgcttgcttttctggagtttcagggaagccaaagttcaaaagccaaggactttccatgattaaagttccattctcaagaaagcaccactatgcattaatgtcaataagtcaccatgacaaaccagtaaaatagggcaaatataatcttacttttcatatattagtgatgttaaaaaaatggcccattggctcatgcctgccatcccagcactttgggaggccaagatgacaattacttgaacccaggagtttgagaacagcctgggcaacatagaccctgtctctgcaaaaaaaaaattaa

SEQ ID NO: 33257 - DNA, 530 bp, Homo sapiens
ttataaaaaaaatggtaaagcagcctattgggattcgctgcttcccttccccgtgagtcctcccagtccagacatgtcctcagagctgccacttcctgatgtactcccttgcagtgcttagctccccacagtggagcttggagggtgctgtcttaacatctctccttcccatgatagggatctgcccatttcaggggattcttcctgctgccttcaaactgagcctcatttttggaggtggtagggatgaaggagaggggatggaggggttgtaagagctgaggagtgtgaggacttgtgatggagtttcagagttggggtgagaagggtagcccatgaagagggccagaagagggactatagacagcatcataaagaaatttaaatttctttatatttggtaaaagtatttagtgttataaatcattatgaatgaatgtactaaaagaaagaatataataaaagatcttacttttatttatcatgaaggggaaacaaagttgcttgtgtccaaagtaacattattgcac

SEQ ID NO: 33258 - DNA, 1825 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatggaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaa

SEQ ID NO: 33259 - DNA, 889 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagatatacaaccacttcctgttgtgtcacacttgcctgcagtaacatgctgtaaggtttgtggcataggagcagtgggccataccatataatcaaggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatggcgtgtgtcagcatcgcacgagcagccacatgcatgcgagagcacactcctcggacctcgagaagatactcgactgac

SEQ ID NO: 33260 - DNA, 368 bp, Homo sapiens
actactactaaattggcggccgcgtccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaaaaaaaagtcgacgcggccgcgaat

SEQ ID NO: 33261 - DNA, 3042 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatgggctgtggctctctgagggcttagactctgccttattaccttttcctaagctgtagaagaggtcctgctggcccgagtggacgtgttgagcgattgctggatgaaagactagcggaggtcctgcctgccctgtgacgctacctcccaagggacagtaacggcctccccaggggcttcctcccgagggtcgccccacacatgctgctcgaggggcccctgtggctgtctctgaacattcagcatctcactcctcctcggagccacctctgcccagttgaagccctgggcccagggttgggcctccccggcccaggcccatacaacctcggcacgttttgtaatccagtgcggtcctgttctgccctcagcccttcttccatcagcactcattctggttctgattccggtcactgctggcatcaatccctgtacttcagaggtagcgatggcagccctttcagagcccaagtggccacccagccttgcagcccctggctcaccttccacttgctctctgcaactgcccctgccagccctggccttgcctcctggactccagatcgcctcgggtttggccacgcctcgtcattccctctgttgctgtgtgctctgggaggcagttgtggcctctttccagttgccgtagcaacttctataaagaaactgctcacttaaccttgtcagtggctcctttccaagccagaatccagactctgaaacagggcgtgccggaccctgcatgcttgggacgctccagcccactgtcactcactgacagtgccatggctgcctgtttgtggttccccgtgcgagccttggactttctcacctctgctgtacacatgctgcctgttcctcagacatccccttccttcccagctggctaaaactcctttgttctttggttttaagtgttaactgaggtctttccccctctctggcttttgccgtattcttcaccatcaagtgaggttctgtagccccgcttgatgcttctcttggaggcacacaggcgtgtgcactgcaagatgacggtctgtttcttctccaacatatgcccaggtcttgctggttcctttgcatgacacaacggctcctcaggaaacacttgctgacctgtgaggggctgttcttggagtctccctgtcaggtgtgacaggttggggagaggctctgggtgatgttgtgtttcctgggttctcccatctctcactccagaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaa

SEQ ID NO: 33262 - DNA, 4310 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatgatatacaaccacttcctgttgtgtcacacttgcctgcagtaacatgctgtaaggtttgtggcataggagcagtgggccataccatataatcaaggtgtcacatcccggtggctggacatgccctcttgggcttggcagatgccagtggatccatacaactgctccgcctggtggaatctgaggtcagtgacttgcacttgttctgtggggcagaagggacctgaatagagagggttggggaggaggctgtgctgatacagacatttttctaaaacgatctctcttcaatggtgagctatatataaacgttctaagataatgtggagtctatttttaagttgtattgcgttctacatccaactccaagaggaagtcacctcatgtgtcaccagcagaagggctgaagtgacaggatgttcattgacctgtcagtggatctgaaagttctctaaggagagcctgggcaagcattcttaggttgatgctggggcccagagtagcagtgagcatcctgtgtgaagatggcatttctcactgattattggaaaagcacgtgagtcctgtgtgaatttttccgagtttctcacagtgctctggagccatgcattaacaaagtgacttcatctgatagctgtcggggaggagaacggggatgtcccgtagtggggtgatgtaaacagcctgtgtaggaaaaggccttgcttaaggcagcttagagcagttgccctgtcttagaaaggagggaaagagcagccacaggaaagctgtgggcccaagggaggagtgcatgaacccaggaaagggctttggtacagcagcctgctgggagcagggatggagttaagcactggccaggctgtttaggaaatgaaatttatatagatctgcataaagagcaaccacgttctcatggctgctcgcggcttctgaagtggaaaccagaggagtttccccattgtctctgtctcgggaggcgagtgttccagtggccctggaggcctggggtgggaaactgtgtgtgccactgtggtctggagcctgcacaggcatctcgacagcatctaggagcgcaaggatggcaagggggtgtgaaagggagggagaccatgccccaagatcaagcctgtgggaaagttgtcctgcaagtgtgaggagtgtgagctccagtgtccccaggtcttctcggggcccctagcaggggtttcagtgttaggtggaggtgtgactcagtgactgatgtacttcattcgcataggttgtaaatgagggaacgatgacttccctgcaggagaggaaaagtcttttgggggttctggggcggctacttccctttgatggagtttcttcttctccagtaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatgggctgtggctctctgagggcttagactctgccttattaccttttcctaagctgtagaagaggtcctgctggcccgagtggacgtgttgagcgattgctggatgaaagactagcggaggtcctgcctgccctgtgacgctacctcccaagggacagtaacggcctccccaggggcttcctcccgagggtcgccccacacatgctgctcgaggggcccctgtggctgtctctgaacattcagcatctcactcctcctcggagccacctctgcccagttgaagccctgggcccagggttgggcctccccggcccaggcccatacaacctcggcacgttttgtaatccagtgcggtcctgttctgccctcagcccttcttccatcagcactcattctggttctgattccggtcactgctggcatcaatccctgtacttcagaggtagcgatggcagccctttcagagcccaagtggccacccagccttgcagcccctggctcaccttccacttgctctctgcaactgcccctgccagccctggccttgcctcctggactccagatcgcctcgggtttggccacgcctcgtcattccctctgttgctgtgtgctctgggaggcagttgtggcctctttccagttgccgtagcaacttctataaagaaactgctcacttaaccttgtcagtggctcctttccaagccagaatccagactctgaaacagggcgtgccggaccctgcatgcttgggacgctccagcccactgtcactcactgacagtgccatggctgcctgtttgtggttccccgtgcgagccttggactttctcacctctgctgtacacatgctgcctgttcctcagacatccccttccttcccagctggctaaaactcctttgttctttggttttaagtgttaactgaggtctttccccctctctggcttttgccgtattcttcaccatcaagtgaggttctgtagccccgcttgatgcttctcttggaggcacacaggcgtgtgcactgcaagatgacggtctgtttcttctccaacatatgcccaggtcttgctggttcctttgcatgacacaacggctcctcaggaaacacttgctgacctgtgaggggctgttcttggagtctccctgtcaggtgtgacaggttggggagaggctctgggtgatgttgtgtttcctgggttctcccatctctcactccagaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaa

SEQ ID NO: 33263 - DNA, 3507 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatgatatacaaccacttcctgttgtgtcacacttgcctgcagtaacatgctgtaaggtttgtggcataggagcagtgggccataccatataatcaaggtgtcacatcccggtggctggacatgccctcttgggcttggcagatgccagtggatccatacaactgctccgcctggtggaatctgaggtcagtgacttgcacttgttctgtggggcagaagggacctgaatagagagggttggggaggaggctgtgctgatacagacatttttctaaaacgatctctcttcaatggtgagctatatataaacgttctaagataatgtggagtctatttttaagttgtattgcgttctacatccaactccaagaggaagtcacctcatgtgtcaccagcagaagggctgaagtgacaggatgttcattgacctgtcagtggatctgaaagttctctaaggagagcctgggcaagcattcttaggttgatgctggggcccagagtagcagtgagcatcctgtgtgaagatggcatttctcactgattattggaaaagcacaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatgggctgtggctctctgagggcttagactctgccttattaccttttcctaagctgtagaagaggtcctgctggcccgagtggacgtgttgagcgattgctggatgaaagactagcggaggtcctgcctgccctgtgacgctacctcccaagggacagtaacggcctccccaggggcttcctcccgagggtcgccccacacatgctgctcgaggggcccctgtggctgtctctgaacattcagcatctcactcctcctcggagccacctctgcccagttgaagccctgggcccagggttgggcctccccggcccaggcccatacaacctcggcacgttttgtaatccagtgcggtcctgttctgccctcagcccttcttccatcagcactcattctggttctgattccggtcactgctggcatcaatccctgtacttcagaggtagcgatggcagccctttcagagcccaagtggccacccagccttgcagcccctggctcaccttccacttgctctctgcaactgcccctgccagccctggccttgcctcctggactccagatcgcctcgggtttggccacgcctcgtcattccctctgttgctgtgtgctctgggaggcagttgtggcctctttccagttgccgtagcaacttctataaagaaactgctcacttaaccttgtcagtggctcctttccaagccagaatccagactctgaaacagggcgtgccggaccctgcatgcttgggacgctccagcccactgtcactcactgacagtgccatggctgcctgtttgtggttccccgtgcgagccttggactttctcacctctgctgtacacatgctgcctgttcctcagacatccccttccttcccagctggctaaaactcctttgttctttggttttaagtgttaactgaggtctttccccctctctggcttttgccgtattcttcaccatcaagtgaggttctgtagccccgcttgatgcttctcttggaggcacacaggcgtgtgcactgcaagatgacggtctgtttcttctccaacatatgcccaggtcttgctggttcctttgcatgacacaacggctcctcaggaaacacttgctgacctgtgaggggctgttcttggagtctccctgtcaggtgtgacaggttggggagaggctctgggtgatgttgtgtttcctgggttctcccatctctcactccagaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaa

SEQ ID NO: 33264 - DNA, 1691 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaaggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatggaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaa

SEQ ID NO: 33265 - DNA, 1785 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagatatacaaccacttcctgttgtgtcacacttgcctgcagtaacatgctgtaaggtttgtggcataggagcagtgggccataccatataatcaaggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatggaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaa

SEQ ID NO: 33266 - DNA, 3279 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaaggtgtcacatcccggtggctggacatgccctcttgggcttggcagatgccagtggatccatacaactgctccgcctggtggaatctgaggtcagtgacttgcacttgttctgtggggcagaagggacctgaatagagagggttggggaggaggctgtgctgatacagacatttttctaaaacgatctctcttcaatggtgagctatatataaacgttctaagataatgtggagtctatttttaagttgtattgcgttctacatccaactccaagaggaagtcacctcatgtgtcaccagcagaagggctgaagtgacaggatgttcattgacctgtcagtggatctgaaagttctctaaggagagcctgggcaagcattcttaggttgatgctggggcccagagtagcagtgagcatcctgtgtgaagatggcatttctcactgattattggaaaagcacaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatgggctgtggctctctgagggcttagactctgccttattaccttttcctaagctgtagaagaggtcctgctggcccgagtggacgtgttgagcgattgctggatgaaagactagcggaggtcctgcctgccctgtgacgctacctcccaagggacagtaacggcctccccaggggcttcctcccgagggtcgccccacacatgctgctcgaggggcccctgtggctgtctctgaacattcagcatctcactcctcctcggagccacctctgcccagttgaagccctgggcccagggttgggcctccccggcccaggcccatacaacctcggcacgttttgtaatccagtgcggtcctgttctgccctcagcccttcttccatcagcactcattctggttctgattccggtcactgctggcatcaatccctgtacttcagaggtagcgatggcagccctttcagagcccaagtggccacccagccttgcagcccctggctcaccttccacttgctctctgcaactgcccctgccagccctggccttgcctcctggactccagatcgcctcgggtttggccacgcctcgtcattccctctgttgctgtgtgctctgggaggcagttgtggcctctttccagttgccgtagcaacttctataaagaaactgctcacttaaccttgtcagtggctcctttccaagccagaatccagactctgaaacagggcgtgccggaccctgcatgcttgggacgctccagcccactgtcactcactgacagtgccatggctgcctgtttgtggttccccgtgcgagccttggactttctcacctctgctgtacacatgctgcctgttcctcagacatccccttccttcccagctggctaaaactcctttgttctttggttttaagtgttaactgaggtctttccccctctctggcttttgccgtattcttcaccatcaagtgaggttctgtagccccgcttgatgcttctcttggaggcacacaggcgtgtgcactgcaagatgacggtctgtttcttctccaacatatgcccaggtcttgctggttcctttgcatgacacaacggctcctcaggaaacacttgctgacctgtgaggggctgttcttggagtctccctgtcaggtgtgacaggttggggagaggctctgggtgatgttgtgtttcctgggttctcccatctctcactccagaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaa

SEQ ID NO: 33267 - DNA, 2456 bp, Homo sapiens
  misc_feature (28)..(28): n is a, c, g, or t
ataggcagagaggatcgactatgcaggncaggagttggaaaccaatgcagcgtcaaaatagtgggcctctgttctccatatggagcagaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatgggctgtggctctctgagggcttagactctgccttattaccttttcctaagctgtagaagaggtcctgctggcccgagtggacgtgttgagcgattgctggatgaaagactagcggaggtcctgcctgccctgtgacgctacctcccaagggacagtaacggcctccccaggggcttcctcccgagggtcgccccacacatgctgctcgaggggcccctgtggctgtctctgaacattcagcatctcactcctcctcggagccacctctgcccagttgaagccctgggcccagggttgggcctccccggcccaggcccatacaacctcggcacgttttgtaatccagtgcggtcctgttctgccctcagcccttcttccatcagcactcattctggttctgattccggtcactgctggcatcaatccctgtacttcagaggtagcgatggcagccctttcagagcccaagtggccacccagccttgcagcccctggctcaccttccacttgctctctgcaactgcccctgccagccctggccttgcctcctggactccagatcgcctcgggtttggccacgcctcgtcattccctctgttgctgtgtgctctgggaggcagttgtggcctctttccagttgccgtagcaacttctataaagaaactgctcacttaaccttgtcagtggctcctttccaagccagaatccagactctgaaacagggcgtgccggaccctgcatgcttgggacgctccagcccactgtcactcactgacagtgccatggctgcctgtttgtggttccccgtgcgagccttggactttctcacctctgctgtacacatgctgcctgttcctcagacatccccttccttcccagctggctaaaactcctttgttctttggttttaagtgttaactgaggtctttccccctctctggcttttgccgtattcttcaccatcaagtgaggttctgtagccccgcttgatgcttctcttggaggcacacaggcgtgtgcactgcaagatgacggtctgtttcttctccaacatatgcccaggtcttgctggttcctttgcatgacacaacggctcctcaggaaacacttgctgacctgtgaggggctgttcttggagtctccctgtcaggtgtgacaggttggggagaggctctgggtgatgttgtgtttcctgggttctcccatctctcactccagaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaa

SEQ ID NO: 33268 - DNA, 2328 bp, Homo sapiens
tgatagcagcagctgctgcgtgatcgactctgaggaccccgttggcgtgagagcaccaggcacatcaattcgaggcctggattgctgctttcaattactggcatccagaaattgtgtattcagggggcgacgatggccttctgaggggctgggacaccagggtacccggcaaatttctcttcaccagcaaaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatgggctgtggctctctgagggcttagactctgccttattaccttttcctaagctgtagaagaggtcctgctggcccgagtggacgtgttgagcgattgctggatgaaagactagcggaggtcctgcctgccctgtgacgctacctcccaagggacagtaacggcctccccaggggcttcctcccgagggtcgccccacacatgctgctcgaggggcccctgtggctgtctctgaacattcagcatctcactcctcctcggagccacctctgcccagttgaagccctgggcccagggttgggcctccccggcccaggcccatacaacctcggcacgttttgtaatccagtgcggtcctgttctgccctcagcccttcttccatcagcactcattctggttctgattccggtcactgctggcatcaatccctgtacttcagaggtagcgatggcagccctttcagagcccaagtggccacccagccttgcagcccctggctcaccttccacttgctctctgcaactgcccctgccagccctggccttgcctcctggactccagatcgcctcgggtttggccacgcctcgtcattccctctgttgctgtgtgctctgggaggcagttgtggcctctttccagttgccgtagcaacttctataaagaaactgctcacttaaccttgtcagtggctcctttccaagccagaatccagactctgaaacagggcgtgccggaccctgcatgcttgggacgctccagcccactgtcactcactgacagtgccatggctgcctgtttgtggttccccgtgcgagccttggactttctcacctctgctgtacacatgctgcctgttcctcagacatccccttccttcccagctggctaaaactcctttgttctttggttttaagtgttaactgaggtctttccccctctctggcttttgccgtattcttcaccatcaagtgaggttctgtagccccgcttgatgcttctcttggaggcacacaggcgtgtgcactgcaagatgacggtctgtttcttctccaacatatgcccaggtcttgctggttcctttgcatgacacaacggctcctcaggaaacacttgctgacctgtgaggggctgttcttggagtctccctgtcaggtgtgacaggttggggagaggctctgggtgatgttgtgtttcctgggttctcccatctctcactccagaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaa

SEQ ID NO: 33269 - DNA, 2561 bp, Homo sapiens
ctcacagacagtcacccaggggagcttcctcacagacagtcacccaggggagcttcctcacagacagagtcatccaggggagcttcctcacagacagagtcacccaggggagcttcctcacagacagagtcacccaggggagcttcctcacagacagtcaccccggggagcttcctcacagacagtcacccaggggagcttcctcacagacagagtcaccccggggagcttcctcacagacagtcaccccggggagcttcctcacagacatcaacggcctaactgagaacactcatttcctgtcattagtggtgttgatgcttctctttctccacacagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatggctgtagaagaggtcctgctggcccgagtggacgtgttgagcgattgctggatgaaagactagcggaggtcctgcctgccctgtgacgctacctcccaagggacagtaacggcctccccaggggcttcctcccgagggtcgccccacacatgctgctcgaggggcccctgtggctgtctctgaacattcagcatctcactcctcctcggagccacctctgcccagttgaagccctgggcccagggttgggcctccccggcccaggcccatacaacctcggcacgttttgtaatccagtgcggtcctgttctgccctcagcccttcttccatcagcactcattctggttctgattccggtcactgctggcatcaatccctgtacttcagaggtagcgatggcagccctttcagagcccaagtggccacccagccttgcagcccctggctcaccttccacttgctctctgcaactgcccctgccagccctggccttgcctcctggactccagatcgcctcgggtttggccacgcctcgtcattccctctgttgctgtgtgctctgggaggcagttgtggcctctttccagttgccgtagcaacttctataaagaaactgctcacttaaccttgtcagtggctcctttccaagccagaatccagactctgaaacagggcgtgccggaccctgcatgcttgggacgctccagcccactgtcactcactgacagtgccatggctgcctgtttgtggttccccgtgcgagccttggactttctcacctctgctgtacacatgctgcctgttcctcagacatccccttccttcccagctggctaaaactcctttgttctttggttttaagtgttaactgaggtctttccccctctctggcttttgccgtattcttcaccatcaagtgaggttctgtagccccgcttgatgcttctcttggaggcacacaggcgtgtgcactgcaagatgacggtctgtttcttctccaacatatgcccaggtcttgctggttcctttgcatgacacaacggctcctcaggaaacacttgctgacctgtgaggggctgttcttggagtctccctgtcaggtgtgacaggttggggagaggctctgggtgatgttgtgtttcctgggttctcccatctctcactccagaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaa

SEQ ID NO: 33270 - DNA, 1847 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatggaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaaaaaaaagtcggacgcggccgga

SEQ ID NO: 33271 - DNA, 2283 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatggaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaacacgagtttataacatgtttaaaatgaacattttatgcctcatcatggcaccagaaatgcttgtatagattgagcacagccagtccaaaaatccaaatcccaaaacttttggaaaatcccgcagctgaactcatgtgacgggttgcatatattattaaaactactgagcacagtcacagtggcctgtaatcccagcactttggaaggggctgaggcaggaggattgcttgaggcctggagttcaagaccagcctgggcaacatagcaaaacccagtctctataaaaagtaaaacaaaaattagccaggtgtggtgcatgtgcctatggtcccagccacttgggaggctgaggcaggaggattgttgagcccaggaggtcgaggctgcaatgagccaggggcaacagagcaagactcttatctctaaaaattaaataataaaaaattgtataaacaata

SEQ ID NO: 33272 - DNA, 603 bp, Homo sapiens
agctcggtaccccggatacaccagcgattcgggcaatgtgtgagatgtcagggaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaa

SEQ ID NO: 33273 - DNA, 1694 bp, Homo sapiens
  misc_feature (1553)..(1553): n is a, c, g, or t
  misc_feature (1559)..(1559): n is a, c, g, or t
  misc_feature (1568)..(1568): n is a, c, g, or t
  misc_feature (1575)..(1575): n is a, c, g, or t
  misc_feature (1594)..(1594): n is a, c, g, or t
  misc_feature (1607)..(1607): n is a, c, g, or t
  misc_feature (1609)..(1609): n is a, c, g, or t
  misc_feature (1619)..(1619): n is a, c, g, or t
  misc_feature (1627)..(1627): n is a, c, g, or t
  misc_feature (1685)..(1685): n is a, c, g, or t
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatggaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccacgacccacacccccactcagcccccnccaccnccccaccanacacgcntactgcacccccccacgcncctctccactgancnaacccacagnctacccanaaaagctccccacccctcctaaaccaccttccctgctgcccccctgaaactccactgncccatcctc

SEQ ID NO: 33274 - DNA, 2720 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatgggctgtggctctctgagggcttagactctgccttattaccttttcctaagctgtagaagaggtcctgctggcccgagtggacgtgttgagcgattgctggatgaaagactagcggaggtcctgcctgccctgtgacgctacctcccaagggacagtaacggcctccccaggggcttcctcccgagggtcgccccacacatgctgctcgaggggcccctgtggctgtctctgaacattcagcatctcactcctcctcggagccacctctgcccagttgaagccctgggcccagggttgggcctccccggcccaggcccatacaacctcggcacgttttgtaatccagtgcggtcctgttctgccctcagcccttcttccatcagcactcattctggttctgattccggtcactgctggcatcaatccctgtacttcagaggtagcgatggcagccctttcagagcccaagtggccacccagccttgcagcccctggctcaccttccacttgctctctgcaactgcccctgccagccctggccttgcctcctggactccagatcgcctcgggtttggccacgcctcgtcattccctctgttgctgtgtgctctgggaggcagttgtggcctctttccagttgccgtagcaacttctataaagaaactgctcacttaaccttgtcagtggctcctttccaagccagaatccagactctgaaacagggcgtgccggaccctgcatgcttgggacgctccagcccactgtcactcactgacagtgccatggctgcctgtttgtggttccccgtgcgagccttggactttctcacctctgctgtacacatgctgcctgttcctcagacatccccttccttcccagctggctaaaactcctttgttctttggttttaagtgttaactgaggtctttccccctctctggcttttgccgtattcttcaccatcaagtgaggttctgtagccccgcttgatgcttctcttggaggcacacaggcgtgtgcactgcaagatgacggtctgtttcttctccaacatatgcccaggtcttgctggttcctttgcatgacacaacggctcctcaggaaacacttgctgacctgtgaggggctgttcttggagtctccctgtcaggtgtgacaggttggggagaggctctgggtgatgttgtgtttcctgggttctcccatctctcactccagaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctgcctctcctccattgccttttggcagttgaggatcttaaagccactgtgcatgcaggcggcagatgaggtg

SEQ ID NO: 33275 - DNA, 1420 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaa

SEQ ID NO: 33276 - DNA, 1115 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatgggtgagtggggacccgtggctgctgggcctcagggc

SEQ ID NO: 33277 - DNA, 929 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatggcgtgtgtcagcatcgcacgagcagccacatgcatgcgagagcacactcctcggacctcgagaagatactcgactgac

SEQ ID NO: 33278 - DNA, 1229 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatgatatacaaccacttcctgttgtgtcacacttgcctgcagtaacatgctgtaaggtttgtggcataggagcagtgggccataccatataatcaaggtgtcacatcccggtggctggacatgccctcttgggcttggcagatgccagtggatccatacaactgctccgcctggtggaatctgaggtcagtgacttgcacttgttctgtggggcagaagggacctgaatagagagggttggggaggaggctgtgctgatacagacatttttctaaaacgatctctcttcaatggtgagctatatataaacgttctaagataatgtggagtctatttttaagttgtattgcgttctacatccaactccaagaggaagtcacctcatgtgtcaccagcagaagggctgaagtgacaggatgttcattgacctgtcagtggatctgaaagttctctaaggagagcctgggcaagcattcttaggttgatgctggggcccagagtagcagtgagcatcctgtgtgaagatggcatttctcactgattattggaaaagcacaagagccacgtgctggagccattgtccagccttgccctggaggagcagtgtctggctttgtccctagattggtccactgggaaaactggaaggtaagggccaggcttggtcaggggtcctgagtctttctctgagaaccacttccacttttcaggctagagggctccagccaccttcagcgagctgcgactgtgctcctcagccctgacatcatcactgccagtcctattatgaaaaaaaggtcccccattttagata

SEQ ID NO: 33279 - DNA, 1468 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatgatatacaaccacttcctgttgtgtcacacttgcctgcagtaacatgctgtaaggtttgtggcataggagcagtgggccataccatataatcaaggtgtcacatcccggtggctggacatgccctcttgggcttggcagatgccagtggatccatacaactgctccgcctggtggaatctgaggtcagtgacttgcacttgttctgtggggcagaagggacctgaatagagagggttggggaggaggctgtgctgatacagacatttttctaaaacgatctctcttcaatggtgagctatatataaacgttctaagataatgtggagtctatttttaagttgtattgcgttctacatccaactccaagaggaagtcacctcatgtgtcaccagcagaagggctgaagtgacaggatgttcattgacctgtcagtggatctgaaagttctctaaggagagcctgggcaagcattcttaggttgatgctggggcccagagtagcagtgagcatcctgtgtgaagatggcatttctcactgattattggaaaagcacgtgagtcctgtgtgaatttttccgagtttctcacagtgctctggagccatgcattaacaaagtgacttcatctgatagctgtcggggaggagaacggggatgtcccgtagtggggtgatgtaaacagcctgtgtaggaaaaggccttgcttaaggcagcttagagcagttgccctgtcttagaaaggagggaaagagcagccacaggaaagctgtgggcccaagggaggagtgcatgaacccaggaaagggctttggtacagcagcctgctgggagcagggatggagttaagcactggccaggctgtttaggaaatgaaatttatatagatctgcataaagagcaaccacgttctcatggctgctcgcggcttctgaatggggaaaagacgcggtttccagcttgcagatttgttaagtttctcaggcagattttgactttcagcctttcatacttgtttaagcaactatttgtattaaatgaagttttttgaaaaa

SEQ ID NO: 33280 - DNA, 1100 bp, Homo sapiens
cccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatgatatacaaccacttcctgttgtgtcacacttgcctgcagtaacatgctgtaaggtttgtggcataggagcagtgggccataccatataatcaaggtgtcacatcccggtggctggacatgccctcttgggcttggcagatgccagtggatccatacaactgctccgcctggtggaatctgaggtcagtgacttgcacttgttctgtggggcagaagggacctgaatagagagggttggggaggaggctgtgctgatacagacatttttctaaaacgatctctcttcaatggtgagctatatataaacgttctaagataatgtggagtctatttttaagttgtattgcgttctacatccaactccaagaggaagtcacctcatgtgtcaccagcagaagggctgaagtgacaggatgttcattgacctgtcagtggatctgaaagttctctaaggagagcctgggcaagcattcttaggttgatgctggggcccagagtagcagtgagcatcctgtgtgaagatggcatttctcactgattattggaaaagcacgtgagtcctgtgtgaatttttccgagtttctcacagtgctctggagccatgcattaacaaagtgacttcatctgatagctgttgtaactggagctgttgtaactggagctgttgtaactgagcttactt

SEQ ID NO: 33281 - DNA, 314 bp, Homo sapiens
tgtgtgctggacactggttcagaagccgcctctgcttgcagacacaccatgggtgtgtgcagcatccagagcagccctcatcgggagcacatcctggccacgggaaggtgagtccccaggaggctctcgggcccttctcgtctctttcgctgtccccggggggctcctgggcccttcttccctctttcgctgcctttcctcctggcaccattgcagcatttcgtctgccagtgcttcgccggagtgtaggtatatgggtttggtaaaggggactttgtcctcgagggatgcatgggacaggtctctgggagacg

SEQ ID NO: 33282 - DNA, 536 bp, Homo sapiens
ccggggagcttcctcacagacagtcaccccggggagcttcctcacagacatcaacggcctaactgagaacactcatttcctgtcattagtggtgttgatgcttctctttctccacacagggggcgacgatggccttctgaggggctgggacaccagggtacccggcaaatttctcttcaccagcaaaaggtaactgcccaagggccagcactcggtgcccacaccagcccccgcgttccctgggtcaccagccctcccgttccctgggtgggtctgtgtgctggacactggttcagaagccgcctctgcttgcagacacaccatgggtgtgtgcagcatccagagcagccctcatcgggagcacatcctggccacgggaaggtgagtccccaggaggctctcgggcccttctcgtctctttcgctgtccccggggggctcctgggcccttcttccctctttcgctgcctttcctcctggcaccattgcagcatttcgtctgccagtgcttcgccggagtgtaggtatatgggtttg

SEQ ID NO: 33283 - DNA, 677 bp, Homo sapiens
caccgtaatctccgtttgacaatgaatggtcataaattcaaagaaattgcaggactcttattttgaaattcatataaatgatttctttataagtacacataaaactcttttctcttaaaatatacagaaaaagaaaaatgtacagctgctcagggtaacaaagtattgccttctagaaattctcaggcttcttgtctttaaggataaacaggaagcatttctaattagtgtcttggttgtttgcatattgagcttccaaaatgctttagaaggttcatcttttcaatccgcccttcgcagtcctttatttttcatttgctaagcagaggtaaacttaaaaccatctctatgtgacttatcataaatcccaatcagtgagacctcaaataatgaacttggctctcatttatacacgtgacaaaaggtatacctatataaatatctaataaaaactacctaacagctaaatacaacaaagagaagcaattttcctttctttttcacccaatggctctaattaatcatacagtacagaaaaataagaaaccttttatgtagcttttagtggttttgttcattctagtttccacctgtgagtagcattcatttataaacctgtcttgctgagcacagtgctttcaaaaatgacttgcttgtgactcagaaacaaaaaaaaa

SEQ ID NO: 33284 - DNA, 465 bp, Homo sapiens
ccaagaattcggcacgaggagaggggcggatctgggcccgtttgcaggaggccattgcctaccctctccccacagtgagccagcagccatcagctgatcccacctgggaaaccttcatgcctctctgatggttactgcccacccttaccccacccctcagctcagcctggtatggaaagcaaggtgcacgttggtctttgattgttctgtcctcacagcagagccagctttccccccatgttgctgctgcttttgctgctcatgctgcttgttgttttctcttccttatctttccaaattgtttccttgaaatgcttgtttccaatttttcttagattatgtttctaatttttattccaggtgtttttttttcttacttgacagaaaaaaagaaaaccccaacaatatcttgctgtattatcacattttttataaagttaaagcatttctcttaaaaaaagccgt

SEQ ID NO: 33285 - DNA, 5635 bp, Homo sapiens
cttgtgctaacaatttatgaagcaaaaggcttagaatttgatgatgtcctcctttacaacttttttactgattctgagggatgcccaagttggagcaagctctaaggagagccttacagatgaagccaaggttagcaatgtccaccctgtgatgacagaactgggtaaggtcagttcatagatagagacaattccaggaagacaaatgaggcttggttcctgccctctggatcaggtaatgtgggggacaagaacagcttccttgcatgagagacccctctagcatggcttcactaccactgcttgcagctcatgcagatgatggcagccaaagagtccccacattgacccccagtgacctctgtattggtccactgctttcacttggctcctgagtccttgtgggtttttctccccaagcttagttcattatgggtagagctaccaactcacagccgttgtcctgggttttctagccactgttttctctttcccactatcttttggtggagactcaagctggctgctgactgtactgtggggtcttctctggggacttagctggctgtgtcccagtccttgttgcagacttcctttgcacatgatgcatgcttgaaggggctatgttatacccaagtcaagagcactgttggctttaacactttaaaaatctgccccagaactgaccctttagatagagtccttcctttttttcttatcattttttaaatgttattttgccttaatagcacaactattacaatattgatataggtgctttgcagtttacagagtactttttgaagtcattgtctcactccaccaaccctctgaggttatatgtatttttattactctcattctattttttaaaatttatttttatttttatagagatatggtcttgctgtgttgcccaggctggtctcaaactcctggccttaagtaatcttcctgccttggcctcccgaagtgctgagattataagcatgagccacctttatctgtagataaagcagaaggtcactgagattagtacatttctcatagtcgtaatgtagatggcagagcctggagatgaactcagatgctttgagttctaaatctctttccattttccttccttttaaagcctcgcatgcgaattgaattccagaaccttccacaattagtgtatcattgctgttccttatgtacattcctttcctgttaaattttgctaataaaatcagatgcacactcattaaccctggaaccatttttacctctgaggactaacttttttttctaatgatacatccatcggtcatggttggactgaggctctcctaaaagaggaagggcttataaggaatggaagatcatttcctcattcacacctacctcaactgactccagagaggaaaaccggccattggttgaagtacccctggacaaaccaggctcttctcagggtcgatctctcatggtgaatccagaaatgtacaagctcctcaacggagagctgaagcagctgtacaccgccatcacacgggctcgggtcaacctctggatctttgatgaaaaccgagagaaacgggctcccgcattcaaatatttcattagaagagattttgtccaagttgtaaagacagatgaaaataaagactttgatgatagcatgttcgttaagacctcaactcctgcggagtggattgcacagggagattactacgccaagcaccagtgctggaaggttgcagccaagtgttaccagaaaggaggtgcatttgagaaggagaagttggccctggcccatgacactgccctgagcatgaaatccaagaaagtcagccccaaggaaaagcagttggaatatttggaattggctaagacctatttggagtgcaaagagccaacactgtcccttaagtgtctgagctatgccaaggagttccagctctctgcccagctgtgcgagaggctgggaaagataagagatgctgcctatttctataagcgaagccagtgctacaaagacgctttcagatgctttgagcagattcaggaatttgatctagcactcaaaatgtactgccaagaggagctttttgaagaagctgctattgcagtggaaaagtatgaagaaatgctaaagactaagacccttcccatttccaagctctcctattctgccagtcagttttacttggaagctgcagcaaagtatctgagtgcaaataagatgaaggaaatgatggctgtcctctcaaagctagacatagaagaccagctggtgttcttgaagtctcggaaacgcttagcagaagctgcagacctgctgaacagggaaggtaggagagaagaggctgccctgctgatgaagcaacatggctgcctcctggaggctgccaggctcactgccgacaaggacttccaggcctcatgtctgctgggggccgcccgcctcaatgtggccagggattccgacatagaacacaccaaggacattctgagagaagcacttgatatctgctatcaaactggccagttgtctggcattgcggaggcccacttcctgcaaggggtaatcctgagagactttcagaagctcagggatgccttcttcaagtttgacacgctcaaccactcagctggagtggtggaagcactctacgaagcagccagccagtgtgaggccgagcctgagaagattctgggcctggctccagggggcttggaaatcctcctcagtctggtcagggctctcaaaagagtgaccaacaatgctgagaaggaaatggtcaaatcttgctttgagttttttgggatttcccaggtggatgccaagtattgccagatagctcagaatgaccctgggcccatattaagaataatttttgacctggatttgaacttgagagagaaaaaaacaaaagatcattttttgataatgactgaccaagtgaaattagccctaaacaaacaccttttgggcaggctgtgtcagatcacacggagcctgcttgggaagacctaccgaggagtctgcatgaggtttattgtaggcttaaaatgtgaggatgaaaactgtgaacattttcacaggcctctgcggcgttgtgaagccaagtgtttagttcagtcgaaaatgaacttggtggcaatcaacgggttgcttttggaagccaaaaaagtattccctaaaatcttagcagaagaacttaaagaaattgattatattttgtctacagatatgtatggcctttgcaagtccattctggatgtccttttccctaagcatttccatcagagagtgttgtcagaaaaccccatggcatgcaaagaaatcctcaaaccaaattacaaatccttccggttctacagatttgctttgaaggagtacatccactttctgtttgaaaatgaaagcgcacgcaaccgccgggaatccacagacctgtggctgagtgccatgcaagctttccttctctcttccaactacccggaggagtttgaaaagctgctccaccaggaggaggacaactacaacagggaactcaaagctctagagtctgaaaaggatgaaaggggcagggggagaggcagcaggataaaaggaatagaagggaaatttggcatgctggcacccaacagggatgatgaaaatatggacaagacccacctgtgcttcatccggcttctggagaattgcattgatcaattctacgtgtacaggaacccagaagactacaagaggctctttttccgtttcatgaatgtcctcatcaagaggtgcaaagaaccactcatccccagcattggaaacacagtagccctcctggagttccagttcatccactgtggggtggtgctggcccgcctctggaagaatgtcattctatgcctccccaagagctacattgcactcttgcactactgggagttcctgtttagcaagaaggacaaggagcttggggatgtgttctccatcattcaggaatacaaacccaaggacgtgacaagagccattcaggatttccggttccatctctcctacctcgccaaggtgctatgtggctatgagaatgtgaacttcaacgtcctgcttgatgccttcagtgaaatagactatgtggtctcgggtgaggctgagcggacactggtgctgtgcttggtgatgctagtgaatgctgaggagatcctgcagccatactgcaagcctctcctgtatcgccacttccgggagattgagtcaaggctgcagctcatgagcatggactgccctggccaggttcccgagaggctcctgaaggtggtgaagcgggtcttggtggcagtcaatgtgaagtctgtggctgaggcactgcaggacctgctctttgagcgggatgaagagtacctaatggactgtgactggcggtgggaccctgtgcacaccaaagggtccatagtccgtggcctctattatgaggaggtcagactaaaccgcctgctctgtttggaccctgtggactactttgctgaacctgagtgtgagtttggccaggatgagatggatgaactggcattagaagaccgagaccacgtcctggccaccattctttcccaaaagcaacggaaggcctccatacagcggaagttgaggagggcatgcctggtggtgtctctgtgcatcagttggaggagaagagtgggcacccagatggagcgtgtcagggaggaggccagggagcccagggctgggaacttcaaaaaggcagacgtggacaggacccagtgtgacctatgtggagtgaagtttacccgtggcccagagaactatttcagccccagcaaagcgtttgagggggcagcttccgaggtggcagtcctttccagggctgagctggaaagggaggagtgtcaggagaggaacagcgagtcttacgagcagcatatccatctagaacaccaccagaggcagcaagtggcctaccagaaatactcagaatttttccacgagaaggtggacccggccattgatgaaggcaagctggtggtgcaggacatcgagcaaagtgtatggatccacagtcacgtgggctccaaggagcacagccacatgctgcagaaggtccaggagcacatcaagagggtttcggatatggtggaggacctctacaggcggaaggcctgggctggcgcggaggaggcgatgactcggctggtcaacattctgatcctgtcagtcagggatgcacgagactggttgatgaaaacagagacccgcttaaagaaggaaggtattgttcaggaagatgattatgaaaatgaagttgaagactttggtgagcttcggcctagaaggcgttctcggaaatgtggaaacaaggtgcacgttggtctttgattgttctgtcctcacagcagagccagctttccccccatgttgctgctgcttttgctgctcatgctgcttgttgttttctcttccttatctttccaaattgtttccttgaaatgcttgtttccaatttttcttagattatgtttctaatttttattccaggtgtttttttttcttacttgacagaaaaaaagaaaaccccaacaatatcttgctgtattatcacattttttataaagttaaagcatttctcttaaaaaaagccgt

SEQ ID NO: 33286 - DNA, 347 bp, Homo sapiens
gtatgtcacacctaattcttttcacacaatgaatatttatgtatgagctgaacttccctctggggaagagaatttggagttgagggtaagagagtttatcacaggctcctgtttgtgttttagagcatcattcattcagtatgaggttttgtgtgtttagatgtgggttttgacattagctgtgggttgtttcacagtgtgtcatgggctagttccccctgtgccctgcccttctttggctctctagtacccaagtgccagtgtccagttctcattagccactgttatccttggctcccagggatgcccaagttggagcaagctctaaggagagccttacagatgaa

SEQ ID NO: 33287 - DNA, 6832 bp, Homo sapiens
cttgtgctaacaatttatgaagcaaaaggcttagaatttgatgatgtcctcctttacaacttttttactgattctgagggatgcccaagttggagcaagctctaaggagagccttacagatgaagccaaggttagcaatgtccaccctgtgatgacagaactgggtaaggtcagttcatagatagagacaattccaggaagacaaatgaggcttggttcctgccctctggatcaggtaatgtgggggacaagaacagcttccttgcatgagagacccctctagcatggcttcactaccactgcttgcagctcatgcagatgatggcagccaaagagtccccacattgacccccagtgacctctgtattggtccactgctttcacttggctcctgagtccttgtgggtttttctccccaagcttagttcattatgggtagagctaccaactcacagccgttgtcctgggttttctagccactgttttctctttcccactatcttttggtggagactcaagctggctgctgactgtactgtggggtcttctctggggacttagctggctgtgtcccagtccttgttgcagacttcctttgcacatgatgcatgcttgaaggggctatgttatacccaagtcaagagcactgttggctttaacactttaaaaatctgccccagaactgaccctttagatagagtccttcctttttttcttatcattttttaaatgttattttgccttaatagcacaactattacaatattgatataggtgctttgcagtttacagagtactttttgaagtcattgtctcactccaccaaccctctgaggttatatgtatttttattactctcattctattttttaaaatttatttttatttttatagagatatggtcttgctgtgttgcccaggctggtctcaaactcctggccttaagtaatcttcctgccttggcctcccgaagtgctgagattataagcatgagccacctttatctgtagataaagcagaaggtcactgagattagtacatttctcatagtcgtaatgtagatggcagagcctggagatgaactcagatgctttgagttctaaatctctttccattttccttccttttaaagcctcgcatgcgaattgaattccagaaccttccacaattagtgtatcattgctgttccttatgtacattcctttcctgttaaattttgctaataaaatcagatgcacactcattaaccctggaaccatttttacctctgaggactaacttttttttctaatgatacatccatcggtcatggttggactgaggctctcctaaaagaggaagggcttataaggaatggaagatcatttcctcattcacacctacctcaactgactccagagaggaaaaccggccattggttgaagtacccctggacaaaccaggctcttctcagggtcgatctctcatggtgaatccagaaatgtacaagctcctcaacggagagctgaagcagctgtacaccgccatcacacgggctcgggtcaacctctggatctttgatgaaaaccgagagaaacgggctcccgcattcaaatatttcattagaagagattttgtccaagttgtaaagacagatgaaaataaagactttgatgatagcatgttcgttaagacctcaactcctgcggagtggattgcacagggagattactacgccaagcaccagtgctggaaggttgcagccaagtgttaccagaaaggaggtgcatttgagaaggagaagttggccctggcccatgacactgccctgagcatgaaatccaagaaagtcagccccaaggaaaagcagttggaatatttggaattggctaagacctatttggagtgcaaagagccaacactgtcccttaagtgtctgagctatgccaaggagttccagctctctgcccagctgtgcgagaggctgggaaagataagagatgctgcctatttctataagcgaagccagtgctacaaagacgctttcagatgctttgagcagattcaggaatttgatctagcactcaaaatgtactgccaagaggagctttttgaagaagctgctattgcagtggaaaagtatgaagaaatgctaaagactaagacccttcccatttccaagctctcctattctgccagtcagttttacttggaagctgcagcaaagtatctgagtgcaaataagatgaaggaaatgatggctgtcctctcaaagctagacatagaagaccagctggtgttcttgaagtctcggaaacgcttagcagaagctgcagacctgctgaacagggaaggtaggagagaagaggctgccctgctgatgaagcaacatggctgcctcctggaggctgccaggctcactgccgacaaggacttccaggcctcatgtctgctgggggccgcccgcctcaatgtggccagggattccgacatagaacacaccaaggacattctgagagaagcacttgatatctgctatcaaactggccagttgtctggcattgcggaggcccacttcctgcaaggggtaatcctgagagactttcagaagctcagggatgccttcttcaagtttgacacgctcaaccactcagctggagtggtggaagcactctacgaagcagccagccagtgtgaggccgagcctgagaagattctgggcctggctccagggggcttggaaatcctcctcagtctggtcagggctctcaaaagagtgaccaacaatgctgagaaggaaatggtcaaatcttgctttgagttttttgggatttcccaggtggatgccaagtattgccagatagctcagaatgaccctgggcccatattaagaataatttttgacctggatttgaacttgagagagaaaaaaacaaaagatcattttttgataatgactgaccaagtgaaattagccctaaacaaacaccttttgggcaggctgtgtcagatcacacggagcctgcttgggaagacctaccgaggagtctgcatgaggtttattgtaggcttaaaatgtgaggatgaaaactgtgaacattttcacaggcctctgcggcgttgtgaagccaagtgtttagttcagtcgaaaatgaacttggtggcaatcaacgggttgcttttggaagccaaaaaagtattccctaaaatcttagcagaagaacttaaagaaattgattatattttgtctacagatatgtatggcctttgcaagtccattctggatgtccttttccctaagcatttccatcagagagtgttgtcagaaaaccccatggcatgcaaagaaatcctcaaaccaaattacaaatccttccggttctacagatttgctttgaaggagtacatccactttctgtttgaaaatgaaagcgcacgcaaccgccgggaatccacagacctgtggctgagtgccatgcaagctttccttctctcttccaactacccggaggagtttgaaaagctgctccaccaggaggaggacaactacaacagggaactcaaagctctagagtctgaaaaggatgaaaggggcagggggagaggcagcaggataaaaggaatagaagggaaatttggcatgctggcacccaacagggatgatgaaaatatggacaagacccacctgtgcttcatccggcttctggagaattgcattgatcaattctacgtgtacaggaacccagaagactacaagaggctctttttccgtttcatgaatgtcctcatcaagaggtgcaaagaaccactcatccccagcattggaaacacagtagccctcctggagttccagttcatccactgtggggtggtgctggcccgcctctggaagaatgtcattctatgcctccccaagagctacattgcactcttgcactactgggagttcctgtttagcaagaaggacaaggagcttggggatgtgttctccatcattcaggaatacaaacccaaggacgtgacaagagccattcaggatttccggttccatctctcctacctcgccaaggtgctatgtggctatgagaatgtgaacttcaacgtcctgcttgatgccttcagtgaaatagactatgtggtctcgggtgaggctgagcggacactggtgctgtgcttggtgatgctagtgaatgctgaggagatcctgcagccatactgcaagcctctcctgtatcgccacttccgggagattgagtcaaggctgcagctcatgagcatggactgccctggccaggttcccgagaggctcctgaaggtggtgaagcgggtcttggtggcagtcaatgtgaagtctgtggctgaggcactgcaggacctgctctttgagcgggatgaagagtacctaatggactgtgactggcggtgggaccctgtgcacaccaaagggtccatagtccgtggcctctattatgaggaggtcagactaaaccgcctgctctgtttggaccctgtggactactttgctgaacctgagtgtgagtttggccaggatgagatggatgaactggcattagaagaccgagaccacgtcctggccaccattctttcccaaaagcaacggaaggcctccatacagcggaagttgaggagggcatgcctggtggtgtctctgtgcatcagttggaggagaagagtgggcacccagatggagcgtgtcagggaggaggccagggagcccagggctgggaacttcaaaaaggcagacgtggacaggacccagtgtgacctatgtggagtgaagtttacccgtggcccagagaactatttcagccccagcaaagcgtttgagggggcagcttccgaggtggcagtcctttccagggctgagctggaaagggaggagtgtcaggagaggaacagcgagtcttacgagcagcatatccatctagaacaccaccagaggcagcaagtggcctaccagaaatactcagaatttttccacgagaaggtggacccggccattgatgaaggcaagctggtggtgcaggacatcgagcaaagtgtatggatccacagtcacgtgggctccaaggagcacagccacatgctgcagaaggtccaggagcacatcaagagggtttcggatatggtggaggacctctacaggcggaaggcctgggctggcgcggaggaggcgatgactcggctggtcaacattctgatcctgtcagtcagggatgcacgagactggttgatgaaaacagagacccgcttaaagaaggaaggtattgttcaggaagatgattatgaaaatgaagttgaagactttggtgagcttcggcctagaaggcgttctcggaaatgtggaaagcagagaaaatactaatgtccacacagctgcagcctcctcatccttcggaacattccattctgacttagaattctgagcgctggggcagaagacaaaaagaatgtgaattagcattttaaaaataggggagtctaacaacaccattgctttttattctcattacttctctttcagtggcttaggatctgattgctccctcacctctaaagtgtttccaagtagagtctggcagtattagtttcccccacaaacaaattcaggtagagaagttgtagtcgaagggaatgttgggactcctcactgcatggtccctggggtgtctggctcatccccatcatgacatgagttggtagcagaggactaggtgttaggacagactctcctcacctcagttgctgctgctctgggccaggaaatctctctatggattccctcatctcctgccacactgctgcagcatcaagtgtgctatgagagctgtatgtgcccaggggtgggccctgccactggccaccccgagcccaggacgcattctggtcatctctgagcccacttgtagtgtagcttcttctgttagagatgttagccttttctctctgtggcgacttttctgccttcccttcttctgttttttgtgatcattcttagctacctgtgccaagtcacagttagactacctcagaatgtagtcaagaattcacccagtgttctttggatgtcccttccctagggggaaaggctggggaatgttgctgggagcattcccagctgcctctccaaagtggtcctaactctgccttggctatggtgcagacattccaaaaagtgttttgtatacagccctgtacatctagttttcttggttctccctggcaagttcgctaccctagcttaggctgacgttctgatgagtctctgcttgctgagctcatcactgtgggatggtgacctgcagagctgcagattggagcaagtggacagaggagggagccagctaagccaaatccgtcactgccacttggctggcaggccttataagagggcggatctgggcccgtttgcaggaggccattgcctaccctctccccacagtgagccagcagccatcagctgatcccacctgggaaaccttcatgcctctctgatggttactgcccacccttaccccacccctcagctcagcctggtatggaaagcaaggtgcacgttggtctttgattgttctgtcctcacagcagagccagctttccccccatgttgctgctgcttttgctgctcatgctgcttgttgttttctcttccttatctttccaaattgtttccttgaaatgcttgtttccaatttttcttagattatgtttctaatttttattccaggtgtttttttttcttacttgacagaaaaaaagaaaaccccaacaatatcttgctgtattatcacattttttataaagttaaagcatttctcttaaaaaaagccgt

SEQ ID NO: 33288 - DNA, 406 bp, Homo sapiens
ggtcaaccagaaccatccctttttcggcccaaagctggtcctggtgttatcatgggaggcctccctggcctgagggctgttccaggtccagatagggcacgtcttccactaggctgtcaaaggtcacctgccaataaccccccagcctatgtacctttgcatgggccttgatacctctctgatccttataaaatgagtggagctgaacaccatcaggtccagacttgcagccataatttccctggccttcaccctgcctgactgaagctgttttgttgtgttaggacacagtcgtgcatgaggctccacgcctggcgcctccaggagccacgagtattatgcagggctcgtacactgctgcctgcgtgagaagggccagagtttgtgcggtaggcctcatgtttct

SEQ ID NO: 33289 - DNA, 521 bp, Homo sapiens
aagagagactgcaactaagaaaggagacaggataacaggatgatactatcttataatgaatgggaattacatgttgtaaaaatgtaaaaataaggatttgacccctgcaacaatccaaagagtttagtaaatgaaaagttttaaatctccatttgatatatgaaaaatgaaggcctgggaaaggcaagcatcttgccttatatcacaaatttgatatggaggctggctatctccttacttgttatataccaggcatcctacaaattgtcttatttaaatctcaataatttagggagtatcacccccattttgcagatgagaaaactgagtcccacagtcataaaatagcttgccctaagtcacataactactacatagactaaactggactctaacttaggtcccttattcatatttccgatgatgtttgctttcttttttctttttagcactatggagaataacttgcaatagaaagaaaaaatatgaataagataaacaaggataaggatgaaagctac

SEQ ID NO: 33290 - DNA, 306 bp, Homo sapiens
aaatattgattggtccctagcctacaccaggacaattaactagaatggcagcatttaggcaaagctgggttaaatcagtatgacaggacacactaactagacttctcttttctgtggaagcattttaatcacatctctcagacctcactaggtgttgtattcatggcaatggaaacctgaatattcatgggatgggaaagagcctgcctggttctgcagtgtctgatagaattaatttcttcgtgtcaaaagtgggcaaatagaactctcttgtgggtcgcagtatttagaaggcacatagtgggg

SEQ ID NO: 33291 - DNA, 654 bp, Homo sapiens
caagaccattctggaaaggaaaatgacagtttcgttaaaagagagtttaaggagaagtttcatgtaatagacattagaaaatccttcagctacaatcagtggaaatgcttagtaactatattacatatcctttaaaatacctctaaagtcatttgaggtaggggttaacaaaattggggaaattattttaagaaataaagagcaaataaaaatacttatctctggcttttgatggactgtccttgcagttaggatgtgtaggaaatcctcagttctgtttctttagtcccaagcatgctcatgttttcttagcttttggcatgattgattcagcatgagagaggcaataggggataagtaggagtacctgtgccttaataaagatttgtaaattaagtggaagatggttatagaagagtagactgggtccagattgtgtaagaccaagaatgtcaggttcataacttttagagcaggagaattgtcaagtaaaagtgatggtgttaggaatattaccctggtaattaagtatatcagggtgtccaatcttttggcttccctggaccacattaggaaaataattgtcttgggccacacataaaatatgctaacactagtgatagctgatgagcttaaaattgcaaaaaaaaaaaa

SEQ ID NO: 33292 - DNA, 811 bp, Homo sapiens
atggagtctcactctgttccccaggctggagtacagtgtacagtggcacgatctcagctgaccacaacctctgcctcccaggctcaaccaattttcgtgcctcagcctccaatgtagctgggattacaggcacctgccaccatgcctagctaattttttatatttttagtaaagacagagtttcgctgtgttggccaggctgctcttgaactcctgagctcaggcaatctgcctgccttggcctccccaagtgctaggattacagacgtgagccaccgtgcctggcccccaagttccttagttttgacaaatctaacttttttgatgtttcatattgatagacataggattgacattgaggtattctacaactttatatatgaagagcattccagttttcatatatcaggatgcttttggctgcaagtaacagaaattcccaactcaagtggcttaacaaagaatgaattatcacacataacaaaaattccaggattgctaattctctagctcagtgacatcattgaagacccatattcttttcatctttctctgtcaaccacagcttatgggccttatcctttagttcctcatggtttcaagttggttgcagcaactctaaggcaaccctaattcatatatccttatgatagccaaaggaaaaaagttttctgagagtcttctagcgactttcctttcacaactccttgtccaggaactggggtcacatggcccatggcctaaaccaattaaaggcaaaggggaggatgtccaccacggattcacttagggaccaatggaaactgtagcc

SEQ ID NO: 33293 - DNA, 402 bp, Homo sapiens
taaaaataccagttgacattagactttgtcaagtctaacgcttgctaaaaatctgcatgctatagtctctaaggcaacgaccaaaggaagagtaaaagctgtataatgtcctagcaaatagagattaaaagtagaattgttaaaaatatcaattatcggctgggcatagtggttcacacctgtaatcccagcactttgggaggccgagacaggcagatcacttgaggccaggagttcgagaccagcctggccaacatggtgaaatcctgtctctactaaaaatacaaaaattagcctggtatgatggcaggtgcctgtagtcccagctgcttcggaggctgaggcaggaatcacttgatcgcaccaccacactctagcctggccagcaaagcaagactctgc

SEQ ID NO: 33294 - DNA, 327 bp, Homo sapiens
taggtttagaagactgatgattatttattgtctagaatcttcacaaaatcaaatcacagtcatcactctagtggcatgtacattaaactatgtgcatcaaattccggcccttgaagaacaaggaagcctacggatctggacagagaaaaaggaaaaggaattgcaatggaaattcatgtaagaaaacaattgcagaaacagctcaatacctttgaaaaagatccctatagtaagtaagaaggtaagatccaagccatgtagttatgcatgcctcagagcacacctgactttggtcaaagtcactaagaaatttccaaggtaacaatg

SEQ ID NO: 33295 - DNA, 503 bp, Homo sapiens
gtaggggagatagctatagcagaaatactgcatggagctcagcatttacctttgagtttcctggtggctggagggaaaggaaataccatgcatggctcccacatactagtggcaaaatgctcccaggcttgcattttgagccagatattgctaacacttgaacaaggtcacgcagtaaggcagggagagtggtcaggtttagaatcaaggatttgccaggcatggtgactcacgcctgtaatcccagctctttgggaggctgaagcggaaggatcacttgtgccctggagttcgagaccagcctgggcaacatggtgagatccccatctctacaaaagaaaattgtttttttaattagctgggcgtggtggcacactcctgtagttccaactacttgggaggctgaggcaggagaattgcttgtgccaaggaggtcgaggctacagggatctgtgttcatgccactgcactccagcctgggcaacagagtgagaccctgtctc

SEQ ID NO: 33296 - DNA, 946 bp, Homo sapiens
aacctttgtaagcaaatattctaaggagaatcaatcttattttttaattgaactttttaaaattagggatactataataactgataaagatgaatttctgtgtttctaaagaatctaatttcaattactaccattaacatataaatgtgcttccaaaatccaagcaggtccatacaatttagagatttgaacactgttatcatgctttaattcagtcattcattaaaatattatctattcacttatttgatgattccaaacatttgatattgtattgtgtttttataattatttgaaatctgttcaccagtgctttgtaatggttttattaattgtgtagccattgctacttagatagtaacccactgagcaaaggcagtcatttattttcatccttgaagtaggggaagaaaattattaatttattagttctactttttcctgcattgcttattttgtaaacattttattatgaataatctgttctctttcactgtattaaaaggagaagaaaatgaacatttgagaatggaaaaaagtaataatatacaaataatctagtgctataaaatgcattatagtaagacacttttggtgtcttcgagtgcactatgttggaataaattttatacttgttgcttagtaaatctcagtcatacgtttggtttgaagctgttttttttttttaatttgaagtttaattttaaaagtgccacattgtaaaagttaccgttaaatactatgtagtataaaaaacaacccaagctattgttaatgctctgaatgtttttctttgaaaatttaagtttagagaagaaattccttcatttttctcccctttgctaaaagaaagaaaatctataatatgtaagtctatgaatctttaaataactgaaggaattttagcagtactttgtataataaaaatattttttaaactataact

SEQ ID NO: 33297 - DNA, 1010 bp, Homo sapiens
tgggtgaagaaatctgaggctgccccagtctggaggatgggggtggttaagtcacgcctaagtgcagaggcacacacttgcatacacacagcacacacgcatgcgtatacacacagtgggactggcagcaaggagagacgccctgaataaggaggagctgggagaggttgttgccagaccaagggagacagctgcagatatgtggccggggcaccagcacagggccctcccagacagttgtgtcatcccaggagtggcctggcacctccagccaggttgaagatgagctcacaggctggaagggatgtctccaacccctcagggcctggaatagctgtttgtacagaaaacaggtggacccagcacaccaggacactaagtgtctggagtggagggggttatactggacccaagtggaaagataagcctgggatagggttcctgctctttgggctttctgagatctgccttcaggacagacccactgcacagaacttttcttgctcaatgctcaccaatgtccactgcagcatttatgacagcaaagcatggagcaaaacaggctcacctatcaatgctaattctaggggaccggtgagacaaaccacagcgcctcagtagaatagcttgcagctattagatggcctcttccaaagactgaaataatgcaagaaaatgcttacaacaaactaaagtgaaaagagcaggctaaaaccagtttgcacagtgtaaaggcacacagccccctcccctcctgaagcctcggcctcccagcagcagggagggtggactcggttgatggccagctctgggagcggcagcaggagaggatttcctgaggccggaggtgagcactgccagccccaggaacaggaagaaacggtatctctggagggccaatgagagctgacaccatccccctaggctggacactcacagtggcaagctcaaaaccaaggcaaggctgggcaaggtggctcacgcctgtaatctcagcactttaggaggtc

SEQ ID NO: 33298 - DNA, 398 bp, Homo sapiens
  misc_feature (271)..(271): n is a, c, g, or t
  misc_feature (287)..(287): n is a, c, g, or t
tctcaaaaaaaaaaaaaaaaaaaaaaaaaattcatgtaattctaaaaactgaaatcatagaaatactacacaaagtctatataaggtatttttaaaatataaccttggtacagagaaaagcctttcaaattattattaccaaacaataacggacaatgatcatgtgttttcttacataaaaattaaaaactttgcattcacacacacacacacacacacacacacacacacgattcaagaataggactaatcaggcatggtggctcatgcntgtaatcccagctatntaggaagctgaggatgacttgagcccaaaagttcaggctgcagtgagctaagattgcacgactgcactccagcctgggcaacagagtgagatcctgtctcaaaaaaaaaaa

SEQ ID NO: 33299 - DNA, 666 bp, Homo sapiens
tctgttcccttttccttcgttgtagttttgctattctgtttacaaatattgaccaataggttaggtttcccaaaatagtttcatttagctatacttctggcttcgtcccttttggaatcctcttagcttatgactgatagggctatgaggagatgatttaagtctgtgtaccacttctaatctttacttacttttttgggaggaggggggcaataggtggaagtataaataaatgatttttttcccatttattatacacttgtatttgctaaggaattttaattaggctcttttaagcctaatcctaagtaagttgaacacatcctaagaaagttgaaattttttcttcctgagaacttaccctgccaggtgcagacttattcgaaggagcttttaaaaattctattaatcttgttatagattttagagttcattataataactagtgagatttaatttcttcttgaatcattcttaagtgtgttaatttgataatgttttaaggactgtatgctgtttgtgtatttttttatatattgaacagaaaaagcacacgagtacatgcacctgagtacaggtaaagaggagctgattgaaatatagtttaatctgttctcagtattacttttaggggtggaagaacgttaaggattaattaaaaaaaaa

SEQ ID NO: 33300 - DNA, 453 bp, Homo sapiens
tttttttgcatttttcagtgctttatttacatcacacacaataagttgtgtatatttctcagagagaaaagtcatggtgagttagacgatacttctcaaattttgatgtgaacaataaactagattaatttgtcctgcagagatttttttcaggagatctggaataaagtctgagtttctaaatttctagcaagcttaccaataacaccatgttttgggctcaagaagaatattgtgccaaacatcgaataagtggaagagcctgggtttttcccagtttttctgacccgtaaacaaagacgagagccttcatttccaaagacagatatgtgcaaagaaaatttaagtaggaagggaagcttccagattaaaggtgacagtttatgcacattatctggtaaatctccctaagatacttaataaagaagagaaaaacaattaaccctataatag

SEQ ID NO: 33301 - DNA, 375 bp, Homo sapiens
caccaagctccctcttctgttgttttggtggttttttaaagcatgacatcttgctttctgaaatttcccaactgttcttcccttcctttgctctggacccttctcttgtccctagactattcccttttaattccactcccagcaatctctcctaagcatagggcccagcactagaaggcagtgctggcaggtcaattttgagagttcaaaggtcagccctctaatcccccacaaaagcatgcagagcaactggatagcaaaataaattccgtagacaacatttgcaacaaaactaggtgacaaaacattaatcccaaagtacaagcagttggggacgaaatacctgcaaagattgcatggtattgtgagagagag

SEQ ID NO: 33302 - DNA, 143 bp, Homo sapiens
aaaacatcactttaagcaaagttagaaggcaaataacagattgagagaaaacatttagaatatgtgagatcaaggcgtgggtatccagaatatgtaaggagtacccatcagtcaattaaagttaatgactatgatggttcagt

SEQ ID NO: 33303 - DNA, 253 bp, Homo sapiens
gaattctggcccagctaggatcacttgcctaagtctgttgtcatattacacaaacatggcgacagggagccagtccctagaagtggcaaaccaattccagagaaggtgtttggcatataactcaaaagacagtgcctccaacatatagaagagaagacatggtctctgcctttggcctctagggagaatgataacagaagatgcctgaagtaacagcaagatcataacatctaacccatccctgattctaaga

SEQ ID NO: 33304 - DNA, 456 bp, Homo sapiens
tgagaccaattaagtcagaatctttggaggtgttgaggaatggatttttaaagttcccagatgattataatatgcaaacagatttgagaaaattgaatcactttattccataaatgcagatagtgaggctaagagagggaaagtgacttactcataaccacaccgtgagttagtgaccaagtcaggataagaatccaggtctgcagactcctaggccagaattcttgtctttatactacactgcttctatctctaccctattcctcctctgagcctttgcttttctcatctgtaaaatgacgataataaagcctagagagtgtatgagaatcattaaagcagaagcatttttcttaatgtacaaggttctatacaaatgcaagggaattaatgtataacatatatgtggggctaagtctctaaaacaacataataaaagttgtttttattttagtc

SEQ ID NO: 33305 - DNA, 251 bp, Homo sapiens
ggtgttcaaaactaaaatttgcccttggtcctattcgtttttagaggagtcctacccagttttgatgcctgagggtgttgtttttcctctgtcagtcattttttgacagcccctacactcaagctagaatgagatattcttttctttgtgccctacccttaccctatagtgtacttctatcaaagcaccttcaacatcttttacataattgtttacatttctactgtaagggtcttgggggcagaaactct

SEQ ID NO: 33306 - DNA, 388 bp, Homo sapiens
tgggagacagggtctcgctctgttgcccaggctggagtgcaatggcgggatctcggctcactaaagcctctgcctcccgggctcaagcgattctcctgcctcagcctcctgagtatttgggattacaagcgtgcaccaccacacccggctaattttttgtattttctgtagagacggggtttcgccctgttggccaagctggtcttgaattcttgacctcaggtgatccacccacctcagcctcccaaagtgctaggattataagcatgagccaccccgcccagccgaaatacatttcaacagcttgctttccttacttccagtttttaaccaaaatcactttttaaaagtactttccaagttattgtctagggttaatatatagata

SEQ ID NO: 33307 - DNA, 103 bp, Homo sapiens
gtcagagtcaagggaagtaccattaaaacgaatttgtttccgtctcactcctcctccagctacgctatagccgacaacgcttaccgaatgatgtgtgctgaac

SEQ ID NO: 33308 - DNA, 429 bp, Homo sapiens
atcccagcactttgggaggccaaagtggaaggatcgcttaaggccaggagttagagaccagcctgggcaacataacgagatgctgtctttaccaaaaataaatcatttctttttaacattgttggatttgctttgctaatattttatggagaatttatgtgtctaggttcatgaaagatattggcctgtacttttttttggttttgactggtttggttatttggcaatagcaacctcataaaatgagttgaagtgttctctcaccttctatattctggaagatattatataacattggtgttaattcttctttaaatatttggtagaattcaccagtgaaaccatctgggcctggagatttattttatgaatctttaaaattatgcatgtaattgttaatgatgataaaactattcagattttctgttt

SEQ ID NO: 33309 - DNA, 287 bp, Homo sapiens
ctcaaattatatctatttcgtactataatagcacaagggtgatgctactctaagaaaaggcaaaagttctttaaacagattagggaagatttctgtacataatttttttttattttttattttttttagggttaggtagatttgcaatttccagttcatttaaaaaatcttggctgggcgcggtggttcacgcctgtaatgccagcattttgggaggctgagatgggcagatcatgaggtcaagagatcgagaccttcctggccaacatggtgaaaccccgtctcta

SEQ ID NO: 33310 - DNA, 355 bp, Homo sapiens
tttttttttttaagctgaggccaggcatggtggctcatgcctgtaatcccagcactttgggaggctgaggtgagaggatcgcttgaaactagcccaggagacatgcaaaacctatcgctacaaaaaaataaaaaataaaattaaaaaagctaaaaaattgaaaaagaaagtcccaagcgctgtaaagcacagagcacggaagtgacacacagtgtggcagctgcttgttgtccagacctgccccaccggccagtcaccagctcctgactcactgaccaccctggcctctgccctgtaatcttccaaagaggaaactccaactgtgtcttttaaaactttttactttagagacagg

SEQ ID NO: 33311 - DNA, 453 bp, Homo sapiens
caccaaaaaaaaaaaaaaaaaaatttaccacaaatgagatccttaatatgtaaggaatgatagttttgaagaaagaaacatctcaaaggagatgaacacttctcagttggtttataaagatgcaaaatgtttaacttctgtagtcatgaaaaataaaaattaaagtaactgcaatattatattctacctattaaagggacagtgattgaaagtctacaatactcaatgacattgactgtgatgagatggatatttttgtcaaatagaatgggaatataatttgatacaattatttaggaacagaatttaagcagatatattcagaacattaaaaatgcttatagcttttcatccaacaacacccaatgcaagaatgtactaaagaaataatttgacaagttggtaaagatgtatgtgtaaaggcatgtcttagtttgttatttgaagtagcaa

SEQ ID NO: 33312 - DNA, 444 bp, Homo sapiens
tgaaacctccatggccaaggctcttctggctgcctgatgccagccctcacaccaatgcctcagcatgctgcctcccctagactcaggccactgccactcaagactcgggggcaggtggtacctcctgacccaaccctagggcaggtcccagcaggctctgactcacaactttgggctcctccaatccctccaagctgcccctagggaccacgtcggcacttgctgcttttctgctcctggcagcctgagcctcaggtcttgagctgagggctgctcatcccaaagccagtgttgcaaatgaaggagtctggcagggaaagatcccatactcatgggtggtgcagagagctattcctgccatatgaaagatggatatggatataaactcaatacttgtataatggggacaaaattattaatcgtcccaaagggtatgaattctaa

SEQ ID NO: 33313 - DNA, 1219 bp, Homo sapiens
gttaagggcttgatattctcaagaggggaggccttggaaaaggtgatcaatagtcaagagtctggttccatcattctgtttggcttttggcttttcactaaaacattttcttcatgagggtatttatcataatacacatatgtttttaatgtatcaatcaggaggatgtgtggtcttgtttgttcttgattaaaaagactatgtcaaaaaagaattatttcaaagttgcagtaataattggagcaataagatggtaaggggtaattaaaggatgcagctttcttttagaaacaaaaacaaatctggtgaccacatgtattcttcttttcttccttaatgaatatgatgaaacatgttatagtgagactatggacattagagatacaccaagtacgtgttaacgtgtcggatttgagcccaggttcccacattaactatactcaggaatttgtaactcataacattgtaaactgactggtgatgtgtacatttcataccattttgtatcacggtgatgcctggatgtagtggtattgctagtgcccatatcatcccttctccctgcccaccacacacacacattgtagatgagaagtatattgcttacccttcccattttgaactcttggactacaaaccataaattacccaggtattgctcttgaattattcctcttgaatttaaaggctttctatttccgtggaattggcttggaaaactcagaccaactgagaaggagaaattgtcctgggacaaactgtttttactatatgtcatactgttttcttcttcctgtaaatatcttgttgggcctactgaccagcaaggaaaacataatccaatgcttgtggtcagtactgaatgacttggccctacgtctttgtgtcttttaagaacggtccaatgggtctgtcataacacttcaaacatctgcttctcagtcctagtttatgctttataagccaattcccattggtttaaatagtttctgtgcctttaatatgactgtctatatggattaatagtaatgaacacagtgatgtggtgataatgacaattttctacttagaatttggttaaattcaattgaacttgataaatgttctctgaagtctaggttaagaaaaatagagaaatgaatgtggtagtctggcaatcatcttgctcatgtctggcaatcatcttgctcattgggaaaataagatgtataaaccaaaa

SEQ ID NO: 33314 - DNA, 704 bp, Homo sapiens
aggggttacaaataaaatttgcaattttcacatgtatggaatcctcaaataatgaggatcaattgtgtatcaaggagactaaatattccaattaaaatgtagctttttttcagattggggagaagaaaaaaacaagacccaattatgtctacaagagataccttttgaatataaagacacgggttaaaataaagaggatggaaagataaaccacacagcactaataatagagtgaaaagcacaacactttccacaactgacacaagataaaacttttaaaatctaaacagccatgtatttattaagttaaaatactcagcctacccttttacaaaaagaagactcaaaactcagatggtttcactggtgaagtctatcagacacatgtggaagaaaataaaggagtaaacaattcccaattcattttagaaggtttgcataaacccattaccaaaatatttttcatttataaaaaaactataaaacatgaccataggtgattaacacagatgaaaacatcctcagcaaaacaatggaaagatcaaaatcagtaacttacaaaaagaataatatatcatgatactgcagtatttatcccaggaatataaaatttggattcacatataaaaggcaatttcatttactataataccagatgcaatgaaagcatttgacgaagttccatatccattccgggttaaaaa

SEQ ID NO: 33315 - DNA, 580 bp, Homo sapiens
atcttacgtgttctagtcgccacgttaaaaaaagtgaaaagaggccaccatgcctggccaggaaaataagtattttcaacaaataatactgaaaaaagtggatatccatattaatatggtttgggtctgtgtccccaccaaatcttatgtgaaaatgtaatctccagaggtggggcctgctgggaggtgactggatcatgggaatggatctttcatgaatggtgtaacaccatcctcttggtgctgttcttgtgatacagttctcataagatgtggttgtttaaaagtgtgtggcacctccccacttcgctctcttgctcttgttctggccatgtggtatgtgcctgcttccccttcgccttccgccatgattgtaaattttctgaggcctccccagaagtggaagcctctatgcttccccgtacagcctgcagaactataagccaagtaaacctcttttctttataaacgacccagtctcagttattttatagtaatgtgagaatgcactggtacacatatagataaaaatgaaccttaatccttaatttatgccatacataagttaactagaaatgga

SEQ ID NO: 33316 - DNA, 434 bp, Homo sapiens
tagcaggtttattaatggcctccaaagatattaggtcctaatccctggaacttctgaatgttactttatgtggcaaagtctctgaagatgtgattaaatcaatggcccttgctaagaagagattatcctggattactctggtggtgttaaatgcaatcacatgcatccttgtaagagggaggcagaaggagatttgacacaaatacatggaggaaaaggccatgggaagacagagcagactgagtggatggtgctggccttgaagattggagtgagattcggccacaagccaaggaatgccagcggccacacaaagctggaagaggccaggaagggatgtttccctatagtttctggaggaagcaagctcttgtccacaccttgatttcagcccagtgatactaagtttgtacttctggcctccagaactgtga

SEQ ID NO: 33317 - DNA, 306 bp, Homo sapiens
taaccaatttacaagctcacctgcacacgcacaccccccatgtcctgtcttccctcctgttcagatggaaggagtgtctctgctcctataaagtgcagctgtccacttgggccctgatcacctccactcctacctcgccaggaccctccgcagcagtgacccgcgtcattgctggatttctcatgtcaattacaaacatgctagaagagctacctagattaaaaagaaaaaagttctccttgatcctacctctccctccttctaattactcctcatctctgtgttctgcatttagcacaatttcct

SEQ ID NO: 33318 - DNA, 115 bp, Homo sapiens
caaatggctgtttggaattctgtatcttggaagtcaagctaaacatgatgcctgacccagaattataaatattctatgatgtgaaactgaaacacttgaaagagctttctaaata

SEQ ID NO: 33319 - DNA, 603 bp, Homo sapiens
ccatgttggtcaggctggtctcgaactcccgacctcaggtgatctgcacgcctcagcctcccaaagtgctgggattacaggcgtgagccaccgcacccagcccacgcatttttacataaaaagagatcctttagtccacccaaaggctgatgttagctgcctctgtaacacaactttttcctcaaatgtatggagttttttttaggcttccacttctatacttacctattctcactccctgttttaatttattttttaatttaattattattattatactttaagttttagggtacatgcgcacagtgtgcaggttagttacatatgtatacatgtgccatgctggtgcgctgcacccaccaactcatcatctagcattaggtatatctcccaatgctatccctcccacctccccccaccccacaacagaccccaaagtgtgatgttccctttcctgtgtccatgtgttcccattgttcaattcccacctatgagtgaggaatatggcggtgtttggattttttgttcttgtggatagtttacttcaggaatgatgatttccaatttcatccatgtccctacaaaggacatgaactcatcatt

SEQ ID NO: 33320 - DNA, 735 bp, Homo sapiens
tgcaatctccactcaccacaacctctgcctcctgggttcaagcgattctcctgcctcagcctcccgagtagctgggactacaggcatgcgccaccacacctggctaattttgtatttttagtggagacacggtttcgccatgttggtcaggctggtctcgaactcccaacctcaggtgatcgcctgcctcggcctcccaacagagtgtggtttttaaggtgccccctaccccagcccagggactgaacagtggtttcagagtttagattctgtgatagcaggtgcctcccttctcagcctcaccccaaccctgggcctctgagccctggcttcttgggaggaagcacacacagggtgccacagcactctaccgggtctcctctagggtagccaggacagaaggcctgcatggtggaagactcccactctatacttgcttttattttccagctcctcccccagttccaaaggagtggtggcttctcaattgcatggttgtgagcaaggaaatttcttgcaggatcagggatgtgaagaggctagcaggggaggggaggtttccaggctgccttgggaagtgtggtttggaatatgaattccggggaaggagggaagaagaagatgggaagagatgggaaacaacctcatctttggggctctggaaatctgagacactgggcagataatccacttcctaaagcctagccccaaacactaatttgagagagaaaaaaa

SEQ ID NO: 33321 - DNA, 1265 bp, Homo sapiens
attctcaaaatatattcctcattctcgaagaagcagagaatgccaaggctgcatatctgctgtaatctacctagccctcttctgcttaatatgatccattattgaatcttctcagattaaaatccattcctatatcatctacctttcccaaagtgtgtgcctgtaaacctaccttggaagtggcaagttaactgatttttttgtgtcatttttataccaatccttaaggtcaaagccttttgctatcaatgtatttaaactgagttgctatatgttcactaatttgttttcaaaatgttttgctccaacttaaattatcttttaacatcttttgagtgccaagaattgctaagtaactgtaatatgttgaagagagtaattgccaagcaagcagtcataagccaaaatgtaatgagcttagtatataaccactttagagtatacactcaccactttttgtattcattcatgcaaaccctcctggaagtcgattagaagaggatccaatttgtggaccttttttcctccttttggacacctgagcacaattttttttttcctttcatatttataccactttggaaaattcagtaaacccaattctggcacatcataatggtttcagttagtgaagatgtttattttaataactttaaaatatgactatcctatacataagttatataagagggcataacaatagatgagtagaaatttataaaatttcttggatattttgaatgagaaaaaaacatttttaaaggaattttgttttttccttttttggccaaaccggtacaagttagaaagtgtgctaaggactgaatacttgcctcgtgctttttgccactggatgatgtaagttaagaatggaattgttaatcctaagtatatattttcttgactttcatcagtttctaaagaaatctaatttaagtgttttgcggttttgtttgatctgtatttattgagttctggtcatagaccagcagcttgcacgtcatgctcatgaacagccagaacatagttattggggaacttcatggctcaaaaccttctgaatcatttaacttattttgtatgttgcaaaaaaaaaaaaaaagtttattttgcttgagagtcacctttttttaaaaaaaataactgtacagcttttaagggatgggaggtgggaaaataccctaaaataggatgtagattttttacaattgtgtttatgctagatcatctacaggtgcattatgtaattaaacctaaaattgttt

SEQ ID NO: 33322 - DNA, 545 bp, Homo sapiens
tcagtaagtaaactccgccacagaaaaacttagtagacaaggtgagttcccctgtgctccgtggcaaagagtgcggtgggtgacattgacccatggttaggtaatctggtaaggaaagaccccgttgtaacacatctgagcaacgagaccaaaggaagggcttgctgccacgaggcgaagtctgcttttttgaacagagagcccagcagagttgggcggcaaatcgtgcccagcactgaggccgaggagaaagagagcaggagcattacattactgcaccaagagtaggaaaatatgatgcatgtttgggaccaggcaaccgaaatcccttctcagcagcgcctcccaaagccggcaccgccttccttcggagaaggcgcagagtccccagactcgggctgagccgcacccccatctcctttctctttcctccgccgctaaacacagacgagcacgtgagcgtcgcagcccgtcccagctgtgcctcagctgaccgcctcctgattggctgagagcggcgtgggctggggtggggacttgccgcc

SEQ ID NO: 33323 - DNA, 405 bp, Homo sapiens
gcctcaaatttataaaggaccaggagttccttagtcaaagcccaattcaacttgtagctgttactgattctgaatgagaacagaaaagactgcttactcttattttttggggaagatgtaaatactctatatgacagctgggccccagtccctacatcctatttgtgcagaaggctgaagacatagccatctgctgccaataatctacatgatatatggggaacatctgaaatgccgatgtttgatatttgctctattgcaacgaagtcagcctgaaaatgctcttcaataagggctttactcatcaaaggacctggacaaatccagttaaacagtctcctatgcttaaaagtataaaattcctaagaaatttatatattaaaacaccaacacacaaaaatagta

SEQ ID NO: 33324 - DNA, 424 bp, Homo sapiens
tgtactacttaatatattagctctttgggcgatctgtacatggtgaccttcattgttttaatcctgaaggtggctttacttcttgttcagtagtaagagttcaaaccttttcactgatgagacagttgggatttctgtggtagaaatagaccagcgttcagagttgatttttgctaaggaaatctttctgcggcacttggcttgttgggaggtctttgagaataagatcacatggtcagtccatcaaagaacagtatgatatgataacaggagcacttatgaagtgacacagcttctctgggttttaatgtcttgcttggaaagtcagaatattaattttgcctgctcatagtcagagaactagttccaggtggctgtactgaagttcttttcaactctatgagctatgattctatgatttatt

SEQ ID NO: 33325 - DNA, 348 bp, Homo sapiens
tatgacattattacttagaagtatacttaattttagtcctatctgaaattctatttaagacattttgccagttaaatttgtttccatctgtttgccttttttcccaccacagtaaaagttataatacaactaaaatttactaccatctgtatgacttagggactggaagaattccttcatccactggagggtattggtattggaaaaacaaaagctaaaacagcttaacacagatgatcataatcaattgggaattaaagtgataagatggagatgctgctaggttgttaagattgctgttcttggggtggagggattaaagtacgtggtgtgactgcattttctgta

SEQ ID NO: 33326 - DNA, 335 bp, Homo sapiens
tattgcgaaggccagtctttcacatgttcacccagttttttgagtgcctggcacaatgctaggcattgaggatttgatggtgaaccagaaacttcctagtctagatggcagggagtgggaatggtgttggtaaactcctaaacgaacacttgcaatacagtatgttaggcaacacaatcttttaggtgttgtgaaaaggacataagtaggtttctgtgcaagcgtggatcaacgatacttgatgtaccttacagtgggacttttgatcctttttaattctgcaagtgtccccactctacctgcatgtatactcagacatgtgcttgtggaaaata

SEQ ID NO: 33327 - DNA, 434 bp, Homo sapiens
gtctcccattctccgacagaaaaagtacacaagtcggtgtttcctgagaacgaaccctgcatgtttagcagcttttgtctcttagaaacactaggttttttgctgcaccaggccatggcaacgttagttttattgattcctttgatttattaggttatggaggttccctgctggttaaaccaccatgaaggattgtggctgaggctttagtgtgtaaaattcatagaaagactaggaaggaaggacgtttgacaggtgagaaggcactcatggggctgccctaccctgcacatttaattatgcatcgcaggtacaggactggtctcttctgctggaccaccgcatatacgaaagcaagggagaagaaagtgcaatactgcctctcaagacacaagtgtttactaagacttattgtgggccagaggtagccagag

SEQ ID NO: 33328 - DNA, 430 bp, Homo sapiens
gagacagagtctcactgtgtcatgcaggtcggagtgcagtggtgcaaactcgactcactgcaacctctgcctatcgggttcaagcagttctcctgtcccagctacttgggaggctgaggcaggagaatcacttgaacctgggaggcagaggttgtggtgaactgagatcatgcccctgcactccagcctgggcaacagagtgagactccatctcaaaaaaaaaaaaaaaaagaaactcagtttctggttacatctgatctttattttttatatatcatctaagctataaagttatattccctatttgtgatcttaaaagaaggactccaggaaagtgttcaaatattcatatatctaaactggaacatatgtttatatttttaaaagtagcctgagaggttggcaactaaagtcatatgttgaatgatca

SEQ ID NO: 33329 - DNA, 352 bp, Homo sapiens
acaatcaatgtttttaaacaagcagaagacttcgataaacaccgcataaaagagaatgcatgcatggccaatgagaacataaaaaagatgctcagcgttgttggtcgtcagggaagtgcagattgaaaatgcaatgggataccactacacacccgccagaatggttaatttaaaaattttaacagtaccaaatgttagagaggctgtgaagcagcaggatgttttatgcatggccagcaaaagtataaaatggtagagccatttggaaaactggcattttctcataaatattcacctatcatgtgatctaaaaattccaaaagaaatgaaactatatgtctacaaaaaaaaa

SEQ ID NO: 33330 - DNA, 457 bp, Homo sapiens
tggggagaaggtacagtaagggaagagttagaatagcagctttacatcctcaggatgctaggtatctacaactctgtgtagctgtgttgctgtatgtgtctatgtgttggattaggaaatgcaaagaaggacataaaagttgtaaaactgctttagagttcattcattaacatctgaaaagacagacaatgctaaaagcgtgtaaaagaagtacaaggtacacagaatttttttttcattttgtttgcctaagcagtgtttttaaggaaaaagttggcatcattagctaagatgttgcaaaaactcaactagaaatttcacttacagctgatcagtcttttgggtaattaacaaaatggggtaggaggagaaattaatggttgtgccaatatttgttggcaattttgatttatttttcagtagcccccaattgataaaattatcactattcaaaaaa

SEQ ID NO: 33331 - DNA, 350 bp, Homo sapiens
taaatatggcaacaagaacttttattacatgggtacatgacttgaagcaaatctctctatcaactaattgagaggtaaaactgtgtggagcacaggtgatgctgaaggagagatgccgcgtgttcttagagcactgcgaaacccatgtctgcatcctccaaatactaaattcatagtatttctgaaattatatatcttgagtatgacattttaatagcattaaaggtaattatttttaatgagaaaaatatattgcaatttgtaaatttagcataggaaaactgattggcatttctattaagaaaccttcaaagccaccttgaattaaagctactttggttactagccaa

SEQ ID NO: 33332 - DNA, 382 bp, Homo sapiens
ccgaggatcctcagatccaataaacccaacaaatcatcaggaaacagttgtcagaagacatcattggtcctgtgtttcctacggaaataaaaaacaataaatattgcactgaatgtttgtggtttggtgtccctgaataataaagaaggaacatatttgcaaaaagttgcatagggtttttttatgcagaattttgtcagaagacagtggtgctgccatgtttttctttgagtgcaaatgtacattgctaagatttttttaagatggcatgtgctttgaaaagaggatattgcatttttaagagtttaaaaatcttatgagtgagaaatattaaaaaatcttattttcccctctttacaagaaataaaagatgttcctcata

SEQ ID NO: 33333 - DNA, 312 bp, Homo sapiens
gaaatcaggaactttattcatctattctagtaaagaagccatttggagattgcaaagtgcagttggaattagcattggtttttgcactgaccatattgaggtattgaatggggagagaaatcattggccagcatcttacaaatctttaataatagctttaatcgctgcagttccccgtgaaaaagtgatcttgtttctgacttaacattttgatggggaaaagagtccagataatttccccttggttgatgctaccctaatagtccttaaggactattaagggtttttttgttttgttttgttttgttttaa

SEQ ID NO: 33334 - DNA, 356 bp, Homo sapiens
gaaaactgcaatcaactgcctatcatctctatggttctggatgtttcctgggctccacaaggttcctgccaggctttcctaaggatgcagtcagtgagtggctagggtaggcgtcatctcaaaggtggatgacattagacgtaaggttctcagctggagttgtttgccaattcatgtggctgcttggtttacttgaaacttccagaggaggagcaggcagaagttatgcagcctcgatgacctcttatagcctcagaagacaaacagcattgcttctacacagttgcatgcctaccaaaattcaacagaaggaagcataaggcagtaggttcaatgggaggagagtcaagatcacc

SEQ ID NO: 33335 - DNA, 267 bp, Homo sapiens
gaaagaaagaagagtaggaactcttcaaagtacaaaaaagaaaaaagaaagcagaagagccactgaaagcagaatacctgtttcaaagagtcaaccggtaactcctgaaaaacatcaagctagaaaaagacaggcatggcttcaggaagaagacaagaatttgagatctggcgtgaggaaatatggagagggaaactggtctaaaatactattgcattataaattcaacaaccggacaagtgtcacattaaaagacagatggaggac

SEQ ID NO: 33336 - DNA, 1074 bp, Homo sapiens
tagttgaaggatctgaggtcctcagaacaatcaagaaaactgacagtttttagctgttgattgttgattcatttcaaggcttagaagtttctgccttgttttcagtagagtttaacaaagtgagccgagactgtagatttatatggctccttcgtaaatggctttgttctaaggaaacctagttgttacagtactctaagttgaaccagtttcccatcataattctactttcaaagagagaagaacacttaataaggctttcccgagcacctgacctaacagtggtgacactcacttccaaaccacattcccactaggtaattgtatgtcgcttcacttgaaaaaaaaaaagcgcattctgcagaatgtcactgggtaatttcctggttgaatatttctgtagaactccagtatgttaccatactacttgtccattgcctttaggtggttaattttggtagcagaaaaatgtttcggttatttttttatttttgacatggagtctccctttgttgccccggctgcagtgcaatggcgtgatctcggctcactgcaacctccacctcccgggttcaagcgattctcctgcctcagtctcctgagtagctgggatgacaggtgcgcaccgccatgcctggctaatttttgtatttttagtagagacagggtttcaccatgttggccaggatggtcttggtggctactgacctcaagtgagccacccacctcggcctcccaaagtgctgggattacaggtgtgagccaccgcacccggctgtttctgttatttttgtacttttttgagggtatctgaaatggttttggtttgtgtattttaaatgttatttaaatggttttttgtttcttttttgtttttgagatgaatctctctatgtcgcccaggctggagtgcactggcacgatcttggctcactgcaacctctgccttcctggttcaagcgattctcctgcctcagcctcccaggtagctgggattacacgtgtgcaccaccatccccagctaatttttgtatttttagtagagacggggctttgccatgctggccaggctgg

SEQ ID NO: 33337 - DNA, 738 bp, Homo sapiens
tagttgaaggatctgaggtcctcagaacaatcaagaaaactgacagtttttagctgttgattgttgattcatttcaaggcttagaagtttctgccttgttttcagtagagtttaacaaagtgagccgagactgtagatttatatggctccttcgtaaatggctttgttctaaggaaacctagttgttacagtactctaagttgaaccagtttcccatcataattctactttcaaagagagaagaacacttaataaggctttcccgagcacctgacctaacagtggtgacactcacttccaaaccacattcccactaggtaattgtatgtcgcttcacttgaaaaaaaaaaagcgcattctgcagaatgtcactgggtaatttcctggttgaatatttctgtagaactccagtatgttaccatactacttgtccattgcctttaggtggttaattttggtagcagaaaaatgtttcggttatttttttatttttgacatggagtctccctttgttgccccggctgcagtgcaatggcgtgatctcggctcactgcaacctccacctcccgggttcaagcgattctcctgcctcagtctcctgagtagctgggatgacaggtgcgcaccgccatgcctggctaatttttgtatttttttttttttttttttttttttttttttttgagacggagtctcgctctgtcgcccaggctggagtgcagtggcgggatctcggct

SEQ ID NO: 33338 - DNA, 384 bp, Homo sapiens
cttgacttttgattagttacgtaagatcttttgaagggcttctctcactctacatacttgatcaggcggttgcccttcctcatgcctctgccagctgggcgtcacgttctgccttctgtttttgctttgtggtgccacacattttgaggctctcctttagtttctccacttatctggctaccatttcaaggtaccattttaccttgtgtcagcgaggattcttaggtgtaagcgatgaagaccgagtctagccaattcaagcagaaaaggaattgacaggctgttgggaagctcacagaattgccagtggggcgatatggaggtacaagttgtgtctggtatgctcaggtcttctctgtacttgtgacctgtttttgcagcatc

SEQ ID NO: 33339 - DNA, 329 bp, Homo sapiens
tctccagggccccgtgcccaggcggggagctggcagtgaggttcctgaatgggaaaggaaacccccacacaggcatgaccatgacacctggctcagtcagctacccgttgagtggtgttttttttttttaactaattgtttttagtggcaaagtatacatgcacatggtttaaaaatatatatccaccctaagaaaagggtttgcaatagaaaggaagttttctatcccagatgtttcttggggtgtatccactgttaacagtttcttgtgtatcttttcaggaattttttaagcacacacaagcataaatatgagttatttttcctga

SEQ ID NO: 33340 - DNA, 555 bp, Homo sapiens
ggtcgacgtccatgccagtaccaaactgactacttcttccagaaatttaaggactactattaggctgagagtcactttaaggttttaagaagtcaggtgacaagggtggaagtggtgaagctcagagctagataaccttaatttcagatcctcactctacaagtttgcttatgagcttttgtgaccactgaaatgtatcttagtctctccaagactcagtttccctaacacataaaaatgggactaaaagcttcagttcagaaatttagtaatgggccaggtgtggtggctcatgcctacaatcccagcaatttaggaggctgaggcaggtggatggtttgagcccaggagttcaagtctgacctgggaaacgtggcaaaactctttctctacaaaaaataaaaattagcctaacatggtggcatgcttctgtagtcccagctacttgggaagctgaggttggaggattgctggagcccaggaagtcgaggctgcagtgagccgtgtttgtgccactgcttctgtcagcctgggttacagggtgaggcgatctca

SEQ ID NO: 33341 - DNA, 377 bp, Homo sapiens
atttcctcgacattccagccttgttcccacctccagcactttgcatatgctgttccctttgccaagaatgctcttcccctaccctgtgcatggctgagttctgcagaccctcaggccttggcttcaacgttgcctcgtccaagaggccttcctcgactactttacttgtggagttcctctatcacaaggcctctgttctttcccttcatggagaatttgccactgcatatccatttgtgtaatttacttgttggttgactgtgcctcccactcgagtgtaagctcatgaggccaggtgccatgcctggttcagtctccactctgtacccagcattgagcacagggcctggtccatagttggcgttcaataaatactt

SEQ ID NO: 33342 - DNA, 325 bp, Homo sapiens
taagatttgtgaaaactgccactttaaataaatgtacacagtaagccataaacagcatgcaaatctgaagttctcaaaactaagtcggtataactggcttttgatgtcaacattattgcatattttataatatattatttgacacagtgatccatctcatccaaaatatttctggtttctgttgaataatttaaaaatattttagtgtggattttaaattctccaaattatataacttacatgagtaactcagagttttaatacatttgtcatttgcaaatctctctccccaacaaaactatgaactttttgagataatagatta

SEQ ID NO: 33343 - DNA, 183 bp, Homo sapiens
ctgagcttccggtgctttggtagcttatactctgagaacaggagcacccgctctcctcccttcatagggttatcatattgaatgaaatcattaaagtgattctttgaccactttcagaatcatcaagacccgcccagggtcacatccattcataataaaatggaaatggcaacacctgaacaa

SEQ ID NO: 33344 - DNA, 457 bp, Homo sapiens
gctcgacagagatgagaaagactgggggaggcttattttgcatttacctaactgctcaccgatgcttcagattaggaaattagggcccagagagtttaagtagtcaatgtttcatgggggaggtgatatttgagctggattttgaagaataataacaatatcttacatctattgagggttcactgtgggccagggatgattctaagtgctttacatggtttgttttacttagtgtccaaaacattcctgtgaaataggatttcggtagacagtctgaggcaggacagggaggacagactgaaaagaatcaatacagctgggcggggcgcagtggctcactcctgtaatcccagcactttgggaggctgaggcgggtggatcacgaggtcaggagatcgagaccatcctggctaacacagtgaaaccccatctctactaaaaattaaaaaaaaaatta

SEQ ID NO: 33345 - DNA, 1367 bp, Homo sapiens
gccaccctagcgatatcaaccgttaaccttccctctacacttatcatcgtcacaattctaattctactgactatcctagaaatcgctgtcgccttaatccaagcctacgttttcacacttctagtatagtcagtagatttagaaaacctgcctacccactccctgggtcatatccacatccacccaggcagctgctgcactaggactgactaaaataccagtgacccatgctctaggtctcatgctaagtagagctggggccccggatgaaactggacccagtcctgacaccaaggaaggagtttccagtacagtggggtgggggcagtggggaggcagatgaagatgagaggctagtgtggtctgggcttcaacagggggctggtatgaggcactgtgagaaccctggagggaaagatttccagttttgcctgggtacaaaaaaagatgagttcccaggaggtgacattggatatgctgggctgtgaaggacacacagagagtctgccaagtgggaaagcagtggcaaggctacattccaggtggacagaacagtatgtgcagggagaagaaatggggaccagtcagattaagaaacagcgtgctcagtgtggctcagtgctaggtgtagggggagggacatggcccctgctcctcagtaggcacaagacactgcgaccaatctcagattcatgctgccactctgctgcgcccactatagccggcttgatcattgctgggcttggaagcagacccacgtttaaatgcagcaagctgcctcctttcaccttggagttggatacaaggcagccctgctctgggccttggtttcctcacctagaaaacggggatgaaagttccttccttaaagggttgctgttacgttttctatcagtatccatcatgaagcctggcagaattccctccacaagtgtttgctggatcggtgaagaatagcaagctaccctcgatcgggcagcctcagcaccatctgcccccaccagccagtggctagaactggaacatggcaatgaagtccattcactcaacgtgtatttatttattctggtgtcaagctgatgaacagttggtgatgacttagagaagggtactagccccatagagcttgtgattttcttgtgggagccttttttactggtggggagcaatgtacagcccagagtctgggatccccagcagcccatcagcactccctggggatgagactactttctagaacattccattctcttccaggcctttgctcttgctatgtcctctgcagtctctagcttattacccatctgccactcagtttgggaactccttaagaatagaaccaggggcaggacgcggtgatcccagaa

SEQ ID NO: 33346 - DNA, 611 bp, Homo sapiens
gcgtgtggtttaccaccagcactgtctgagcgggcacacgggccggggttgcttctgtgagtttcagcaccgctcgccctcaccttcgtgtgcaggcacatgtgcacagccacctctctcagctgccggcaggcgtctgttagtctgcgatattttcctaaagacctacattttgaaaattttagccagtttctttctcaaatctgtggaacagagtttctcttagtgtgtgtgagtatgtgacggagtatgggagagagagacacgcacccaacctgaaagtcggcgtgtgagccttgggtgtggtgtcctgatacccacagatgtttttcgacagctttcaaagtgtgtgggtcatttgcctttcagaagaacagtttgcagctctttcattgcctgaccctgttctttaatgtgataacacttgctaaatatctgctggtatctggtgtggcctttagaggttttacatttttatattaaaaaaaaaagaagtcggatggtttcttgtaatatggtggccctccgtatccatcggttccacatgtgtggtttcaaccaactatgtactgaaaataaaattgcatccttacaaacacgcagactttttt

SEQ ID NO: 33347 - DNA, 509 bp, Homo sapiens
caggatgtggaatcctgaagtcagcgccttgccttctcttaggctttgaagcatttttgtctgtgctccctgatcttcaggtcaccaccatgaagttcttagcagtcctggtactcttgggagtttccatctttctggtctctgcccagaatccgacaacagctgctccagctgacacgtatccagctactggtcctgctgatgatgaagcccctgatgctgaaaccactgctgctgcaaccactgcgaccactgctgctcctaccactgcaaccaccgctgcttctaccactgctcgtaaagacattccagttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaacata

SEQ ID NO: 33348 - DNA, 452 bp, Homo sapiens
ctcagtattttatttactggattgaacagttcaggcttctggccagtatgggaggtgaccatgggtatcaactggcagtgactaaagcagagaatccgacaacagctgctccagctgacacgtatccagctactggtcctgctgatgatgaagcccctgatgctgaaaccactgctgctgcaaccactgcgaccactgctgctcctaccactgcaaccaccgctgcttctaccactgctcgtaaagacattccagttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaacata

SEQ ID NO: 33349 - DNA, 451 bp, Homo sapiens
gcaaatcgccactgatcattttatcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaagtggagatccccttgtggaagatacaaggatgggtccactcatcaaccgacccctgctcgtaaagacattccagttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaacata

SEQ ID NO: 33350 - DNA, 715 bp, Homo sapiens
gaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttaagacagagtttcgctcttgttgcggtgagccgggatcgtgccattgcactccagcctggtcaacagagcgagactccgcctcatta

SEQ ID NO: 33351 - DNA, 92 bp, Homo sapiens
aaatcatgaagaaaatgattttatctttggcgagcagaaaaatattaaaacctgtgcgcttgcagttttttcttatgtaatgtataaatgtc

SEQ ID NO: 33352 - DNA, 349 bp, Homo sapiens
acactctcttgcttcctgtggctaccaaagaagggtgagattatccaattgaaagactgaaaaggacaactgttaatgtgtactaaagagtattatacatctgtttaagagaatatgaattcggtatctccaaggcagaataattgttataaatatataagtaaatatacatatatatgcatacatatatatgagcattcatgaacccgaaaagccaaaatatagctataagctaacactgtttagataatcaataataggtctttaaaaaataagcaatatataatgacaactacctttatagatgttcattatgtatgtaaatgcatacaaatattcactcaaaatt

SEQ ID NO: 33353 - DNA, 4862 bp, Homo sapiens
tgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgctggacacggctcatgtgggtgtgcccttcccctctccccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcggccgagggcacgctgcccgccggctgcccacgcccactggggccgcggcgtggcagcgacgggccgacctatggccacggccacgcgggggctgcgcccgccttcccccacgaggctccaggcggcggaaccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagactccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccaattcagccctggctggagtgccgccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctctatgaagcctaactcttgaggtctctaacataccttgtcatagaggaaaagcacagattatacctggatgattcaggagagtgtatatgaatgaataaggcatccaagtatatatgaatgaataaagtatgtaagtatcaccag

SEQ ID NO: 33354 - DNA, 4811 bp, Homo sapiens
tgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcggccgagggcacgctgcccgccggctgcccacgcccactggggccgcggcgtggcagcgacgggccgacctatggccacggccacgcgggggctgcgcccgccttcccccacgaggctccaggcggcggaaccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagactccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccaattcagccctggctggagtgccgccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctctatgaagcctaactcttgaggtctctaacataccttgtcatagaggaaaagcacagattatacctggatgattcaggagagtgtatatgaatgaataaggcatccaagtatatatgaatgaataaagtatgtaagtatcaccag

SEQ ID NO: 33355 - DNA, 3631 bp, Homo sapiens
tgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgctggacacggctcatgtgggtgtgcccttcccctctccccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcggccgagggcacgctgcccgccggctgcccacgcccactggggccgcggcgtggcagcgacgggccgacctatggccacggccacgcgggggctgcgcccgccttcccccacgaggctccaggcggcggaaccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctctatgaagcctaactcttgaggtctctaacataccttgtcatagaggaaaagcacagattatacctggatgattcaggagagtgtatatgaatgaataaggcatccaagtatatatgaatgaataaagtatgtaagtatcaccag

SEQ ID NO: 33356 - DNA, 3580 bp, Homo sapiens
tgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcggccgagggcacgctgcccgccggctgcccacgcccactggggccgcggcgtggcagcgacgggccgacctatggccacggccacgcgggggctgcgcccgccttcccccacgaggctccaggcggcggaaccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctctatgaagcctaactcttgaggtctctaacataccttgtcatagaggaaaagcacagattatacctggatgattcaggagagtgtatatgaatgaataaggcatccaagtatatatgaatgaataaagtatgtaagtatcaccag

SEQ ID NO: 33357 - DNA, 529 bp, Homo sapiens
gggcctcggatcctccctatcgtacaagaatgcagatgcccatgcgttagggctgtggcagggaaaactggttccccacagcacttcgatgaagacaagtgtgcactggagaggaaggaggaagggccccaggacaggccatctgacaaggagagctgtgggcggggctgagttgaggaaaggagctaaaaaggctgatgagtgtgtgtgtgtgtgtgtgtgtctgcatgcatgtgttgtgtgtgtgcacacacacctgtaacacacacacttgcatccacacctgtaacagcccagggtccttggcacagaatgcatgggactaacagcgacctcttttcagggccaggtgctggacacggctcatgtgggtgtgcccttcccctctccccaggagcagctggctgacctcaaggaagatctggacagggatgactgtaagcaggaggctgaggtggtcatctatgagaccaactgccactgggaagactgcaccaaggagtacgacacccaggagcagctggtgcat

SEQ ID NO: 33358 - DNA, 347 bp, Homo sapiens
tgtctgatacttctactgctaaatgggttaatgtgtaattgcttcactgagcatgtgctgtgacccaggcagcacataaaacagacacaaattccaaccttttaaagcaaagattagataaagattattgatagaaggactaattggacctcactcaccttttctgtgccataaggaaagcagttaggtaaagctgaccttctttggagggaagacacaaggtcaagacatgcccatcaggatgccctttgggcctagacctgatgtgagaatgatgggcttggagtgttctggaaatagctgagaggcttatactaaagttattattgtttttcccaaaaaaaaaa

SEQ ID NO: 33359 - DNA, 375 bp, Homo sapiens
agaacctgtcccaagtctccatactgagcatcataaggatgtatattttctggccaagtggcaatgatgagttttcagagaggatgacactgaggttctgggacgacctgtgtctcacccaaggctgcctgggtaaaggggagcagaaacaggtagagggagctggtctcctgaatccgatccagccccgttttcctgccaagccctgggatgaggacctgagacgccttctcccacccactgctctgcgcattgcacagaagagcggctgctggtaaagttctgggagttctgacacatgcacgccacagaaacacaggactgggggttgtcaccgctatcaacgttaatgacaataaagggaaaacagcattt

SEQ ID NO: 33360 - DNA, 228 bp, Homo sapiens
taattttctaattcactgattcctctgtttaatctttgttgattttagtctcctgctttacttagagttgcactgcttttatttttaacttcttaagttgaatgcttagtccacttaaggttataataatttaacacaatatattttctctgcatttattttagagtttagattttctcttttacccaacagttattagagaagttttttaaatgtagtaattaaaac

SEQ ID NO: 33361 - DNA, 767 bp, Homo sapiens
aattaccaatgtcattttccatagaattagaaaaagcaattctaaagttcttatggaaccaaaaacagcctgaatagtcaaagcacttctaagtaaaaagaacaaattcggaggcatcatcttacatgacttcaagttatactacatatctataacaactaaaacagcatgttactggtagaaaaatagacacatagataaataaaatagaacagataacccagaaacaaagccacatgctacacccaactgatctttgatgaagttgacaaaaataaacaaggaagaaaggagatacccttttcaataagtagtgctgggaaaactggctagccatatgcagaataattaaagtggaatcttatttctcattccatacaaaaattaactcaacatggattaaatatttaaacgtaagatcagaaattataaaaattctggaagaaaacctaggaaaaactcttcaagacatcagcctaaccaaaaatttatgacaaagaccacaaaagcaaatgcaacaaaaataaaaataaataaatgcgacttaattaaactaaaaagtttgtgactagcaaaagaaatagtcaacataataaacaggcaacctacagaatgggacaatatattcacaaattatgcctatgacaaacaactaatatctggaatctacaaggaactcaactcaacaagaaaaaaaacaacccaattaaaaactgggcaaagaacatgcacagacgtttgtcaaaagaataaaaatacaaaaggcc

SEQ ID NO: 33362 - DNA, 388 bp, Homo sapiens
gtctccaaacaccatgtttccttcttaacatgtaactgactctgtaaaaacaatctgtttagatttctcatttaattcagaagttaattaaaagggactgaaataaaaatttgcatgtagttagagattactggttagttacacattaattcagagtttctagagccatttcacagaagctagaaaatataaccaccttgatatcagttttcacaaacttgagtacgtttttaggccttaaaaccttaccattttaaataatttcccttgtatttgaaaataacatataacccatattttctgctaaataatgccatttgtttgtcactatgcctgattggccaaatgttctaatagttatttaacattcaaaacaatgactaccaaa

SEQ ID NO: 33363 - DNA, 394 bp, Homo sapiens
gatatgcatgtacatgagaagtaatggacattcaaaaagccagatcctgctgattccacatttcaatggcttggtttgccaactcatgcatgggtgcctctaaacactaatcagtaatccagttcattgctaaggctgcagagctccaggatctcttattttctcacaggtgggaaaagaccccccgaccttcttggtctaagctctcttctggttacttggtacccacatgtttacaaggtatttattttcattagacctccgatcgttctaaaggcctgcagagcccaacccttcctgcctcctcctctccccatctttaagctataaaaccttggcggagttttctgggctgttctccaggtttttgttttccccactgtccagcatggta

SEQ ID NO: 33364 - DNA, 518 bp, Homo sapiens
agtgctcacctagacccacattcagtgtctcttcactcaccagccggaccagtccccatccacctcccaagttctgcagccagctctgctgatgcattcagaggaggatttaggcaattgtcaacctctgcacatcttgttgtgggtacgcagcagctatgtattttcattgtcatcttttaaatctatgacatagatgagatacgcaggacctaagcctgcatctctatgtgcccattccagcaccaggaaacttttaggggtctgaaacactagtggagctagtgaatgagtgaatgacggtagccagggcagttttgacctgtgtatgtggacattggaaatacacgataggtaactaactgaagtacaaaattgtgtttaaaacttgtgatttgggacaggcgcagtggctcatgtctatagtcgcagcactttgggaggccaaagcgggtggatggcttgagcccaggagtttaagaccagcctgggcaacatggtgaaaccttgtctctacc

SEQ ID NO: 33365 - DNA, 257 bp, Homo sapiens
agtgctcacctagacccacattcagtgtctcttcactcaccagccggaccagtccccatccacctcccaagttctgcagccagctctgctgatgcattcagaggaggatttaggcaattgtcaacctctgcacatcttgttgtgggtacgcagcagctatgtattttcattgtccacatacacaggtcaaaactgccctggctaccgtcattcactcattcactagttccactagtgtttcagacccctaaaagttt

SEQ ID NO: 33366 - DNA, 307 bp, Homo sapiens
catctgtgtccctcttgggtcccagaagttttggagtaatggatctagactgaatgcttctcagtctggatggcctcgggggcggcacacttgctaggctgaacttctcacatccaggtttttccctcggctggtcttgggcttgggggaggctttgcttggggccggttgctgttcctgtcccctgcactgtggaggttgcaggcctctgagaggtaacgcagggaggtgggtagtggccaggtggcccttggtgccctgccctggcccaggcgttccacgcactctgctccctaccctgcagtaa

SEQ ID NO: 33367 - DNA, 477 bp, Homo sapiens
ccacgtccagtcttgtttgtcccttttcaagtatgtaaatcttaattcgcctaaaccggctgcacgtcactcagggccactgtccatgtcttacgctagtgtgtcttttccatgcaaccttgtacaaaacgggccttcaattaacatttcttggttgcttgacttcttaacacacactatgataggttaccttcttcccagggttacatgtttggaaaatagtcttgtctgagttgccaaaatgtggtattctcagtgtgtttacctcatacctgacaatggcacctcagaatgttgaccttcttcggaaacagggtcttcacagaggtaatcgagttcaaatgaggtcaccaggcacagtggctcatgcctgtaatctcatacctgataatgaataactagatgcagaatttattttccacataaatctaattttcttgaacttgcttcattttcctcttttctataatgtaggaa

SEQ ID NO: 33368 - DNA, 503 bp, Homo sapiens
ggcagactctgtccttcagaactgtgagagagcacatttctgttgccctgtgtcacccagtgtgtggtccttcatacagccatcccaggaaacaaatacaccgcctaacactgttctgaagactagaatgtgtctgacttgacctgggtcttgcagccaggacaatcctgtttggaaacccgtatgaactctctcacattcatcattcacttcctggagagacagattttgtaaactttacagagcagcttttaatcattcggtggttcccagattcctaggccagagtctctatactgaataatttataatagaggtcatatccatcatggtggcttgaattctgtcctcccaagaacacaggctcaagtcctgacccctcctacctgtgaatgggaccttatttggaaatggagtctttgcaggtgtaattcagttaagatgaggtaggcccgaaaagcaatgactgacagtcctataagaagagaggacggagacccatg

SEQ ID NO: 33369 - DNA, 565 bp, Homo sapiens
tagctgggcatggtagcactcgcctttggtcccagctacccaggaagctgaggtgggaggatcacttgagcccaggaacttccaggctgcagtgaaccatgattgcaccactacactcagcctgggtgacagagtgagaccctgtctcaaaaataaaaataaaattaaaatgaaaaacagctgccctacttttgtttgtacaggcattggttgatggagattttacttttgggctgttatgagtaaagctggtatgaatacttgtttataaaactttctatggacacatatttttgcttctcttgggtggttgggttatatgggaggtgtatttttaactttctttttttttttttgagacaaggtctcactttgtcatccaggctagagtgcagtggcacaatcttggctcactgcaacctctgcctcctgggttcaagcgattcttgtgcctcagccttccaggtagttgggaccacaggcacacgccaccatgccctgctaattgtttttggatttttggtagagatggggtttcgccatgttgcccaggctggtctccaac

SEQ ID NO: 33370 - DNA, 503 bp, Homo sapiens
gtgtacttgggttcagatctcagcactcccgggtactcttgtgttatctgaatgacattgggcaagtggcttaactgatttgtatcctagatgtgggatctataaaatgaggttgaactatttcccactcagagcccctccacattcaccactcccacgataactccttactgcccatatttgtgactatatgcctcagagcttgtctcttgtttagccagtacttagaacagttgatgccaatgagctgcccctgcatgccaggatccaagcaacgcactgagaaatgagcactgaatgttaccgactcataagttatacttctctttcctcatgcatcttctcagagatgtaggaattcaagagagggagactttctgtgggtaagtggtaatgtggagatgatggaagacttactgattttggagtggcccttgaagggaaggaagaaatgaaaatgtgtgttcagagggatcaggcactgtaagaaatggggagtgctc

SEQ ID NO: 33371 - DNA, 336 bp, Homo sapiens
aatgaggtggtgtttggtagatggtggctaatctgcattttgccaaagcagcatcagtaggtggtccaacaatagtatctcaggcttactaagcatctgtccagataacagggaagagccagctcagtcagtgttactgtctcttctgggctccctgacttgtatttagagcgcaataccaagttgcagatccaactgctggatgacaaagttttgggagttcctgccctccaaccggacgcacaaaacagcatcatctctaatcaaattggttcagtgtaaatggagggtttataaaatagaacgcaatctcaggcaaagtctctgttcttccac

SEQ ID NO: 33372 - DNA, 1636 bp, Homo sapiens
cggctgagccccagcgaccgctctggtcggctgtgtagactgttgggtaggctgcgtgctagcttcggcgcggatccctgggcgtccgtacgtcggagtccttcgtcctccagggtccctgttctttgcgccagcgggaaccactatctctgcactcctggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtggaaaactaccatgaaatctagtgtgcaagaagaatgtgtttcaacaatctcaagcagtaaggatgaagatcctctagctgccaccagagagttcattgagatgtggagattgcttggcagagaagtaccagaacacatcactgaagaagagctcaaaacccttatggaatgtgtttctaacacagcaaaaaaaaaatatttaaaatatttatatacgaaggaaaaagtgaaaaaagctaggcaaataaaaaaggaaatgaaagcagcagcaagggaagaagcaaaaaatatcaagctgctagaaaccactgaggaagataaacagaaaaactttctatttttacgactttgggataggaatatggacatagcaatgggctggaagggtgcccaggccatgcagtttggacaacctttggtttttgacatggcttacgaaaattatatgaaacgaaaagaattgcagaatactgtttcccagcttttagaaagtgaaggatggaacagaagaaatgttgatcctttccatatttatttctgcaatctaaaaatagatggtgctttgcacagagagttagttaaacggtatcaagaaaaatgggacaaattgcttttaacatcaacagaaaagtctcatgtagatttatttccaaaggacagtattatctatttaactgcagattctcccaatgttatgactactttcaggcatgacaaagtttatgtaattgggtcttttgttgataagagtatgcagccaggcacatccctagccaaggcaaaacggctgaacctggcaactgaatgccttccattagataaatatttacaatgggaaattggtaacaaaaatctcaccttagatcaaatgatacgtattttgttatgtctgaaaaacaatggtaattggcaagaggctctgcaattcgttcccaagagaaaacatactggttttctggagatttctcagcattctcaagagtttatcaacagactaaagaaggcaaagacttaattcattttcaaaaggttctctgaatgtgcacagaacacgtggctcaaatgagaacatttgatggcttaaaaagtaaatgcgttagaaatacagttctgttaatgtatttcttcccaaacaattcatttttctcttctaaaggtagtctttcccaactgactgtagggttgtgtcttttcccaattaaatatctgcagaactttgggattatactttgtttactgtagaaagataataaaaagagttgtccaa

SEQ ID NO: 33373 - DNA, 2168 bp, Homo sapiens
  misc_feature (2168)..(2168): n is a, c, g, or t
cggctgagccccagcgaccgctctggtcggctgtgtagactgttgggtaggctgcgtgctagcttcggcgcggatccctgggcgtccgtacgtcggagtccttcgtcctccagggtccctgttctttgcgccagcgggaaccactatctctgcactcctggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtggaaaactaccatgaaatctagtgtgcaagaagaatgtgtttcaacaatctcaagcagtaaggatgaagatcctctagctgccaccagagagttcattgagatgtggagattgcttggcagagaagtaccagaacacatcactgaagaagagctcaaaacccttatggaatgtgtttctaacacagcaaaaaaaaaatatttaaaatatttatatacgaaggaaaaagtgaaaaaagctaggcaaataaaaaaggaaatgaaagcagcagcaagggaagaagcaaaaaatatcaagctgctagaaaccactgaggaagataaacagaaaaactttctatttttacgactttgggataggaatatggacatagcaatgggctggaagggtgcccaggccatgcagtttggacaacctttggtttttgacatggcttacgaaaattatatgaaacgaaaagaattgcagaatactgtttcccagcttttagaaagtgaaggatggaacagaagaaatgttgatcctttccatatttatttctgcaatctaaaaatagatggtgctttgcacagagagttagttaaacggtatcaagaaaaatgggacaaattgcttttaacatcaacagaaaagtctcatgtagatttatttccaaaggacagtattatctatttaactgcagattctcccaatgttatgactactttcaggcatgacaaagtttatgtaattgggtcttttgttgataagagtatgcagccaggcacatccctagccaaggcaaaacggctgaacctggcaactgaatgccttccattagataaatatttacaatgggaaattggtaacaaaaatctcaccttagatcaaatgatacgtattttgttatgtctgaaaaacaatggtaattggcaagaggctctgcaattcgttcccaagagaaaacatactggttttctggagatttctcagcattctcaagagtttatcaacagactaaagaaggcaaagacttaattcattttcaaaaggttctctgaatgtgcacagaacacgtggctcaaatgagaacatttgatggcttaaaaagtaaatgcgttagaaatacagttctgttaatgtatttcttcccaaacaattcatttttctcttctaaaggtagtctttcccaactgactgtagggttgtgtcttttcccaattaaatatctgcagaactttgggattatactttgtttactgtagaaagataataaaaagagttgtccaaaaaaaaaaaaaaaaaaattaaaataaaaaataaaataaaaaaaaaaaaaaaaagaaaaaaaaaaaaaaaaaaaaaagaaaggggggggggggattaaataattttccccgggggggggcccaaaatttatcgcgaccccctttttttatagaaaaaagggggcgcccaaaaaggagggggattaaaaaaaaaagagagggcacggcgaggcaaacaacgctcgtcggggaaaaactcctagtcggatatcggcggaagacccccctgttgcgcggccaaatggggaacacccccacaataataagggagcagagatacaaaactgggcttttaatggtcaccccggctttcgcgcgcaaaaatgtgtcccgcgtatttttataagcgtgccttcactatacaccaggaaacaagaacaagagacgataggatagaccacacaccgatacagatcaaacaccatagaagccaacagtaagcaaagcacattcactactatgctaaacaaacaaaataacgcctcaaatataan

SEQ ID NO: 33374 - DNA, 1181 bp, Homo sapiens
gatccccgttatctccttcttgattgcttggcagagaagtaccagaacacatcactgaagaagagctcaaaacccttatggaatgtgtttctaacacagcaaaaaaaaaatatttaaaatatttatatacgaaggaaaaagtgaaaaaagctaggcaaataaaaaaggaaatgaaagcagcagcaagggaagaagcaaaaaatatcaagctgctagaaaccactgaggaagataaacagaaaaactttctatttttacgactttgggataggaatatggacatagcaatgggctggaagggtgcccaggccatgcagtttggacaacctttggtttttgacatggcttacgaaaattatatgaaacgaaaagaattgcagaatactgtttcccagcttttagaaagtgaaggatggaacagaagaaatgttgatcctttccatatttatttctgcaatctaaaaatagatggtgctttgcacagagagttagttaaacggtatcaagaaaaatgggacaaattgcttttaacatcaacagaaaagtctcatgtagatttatttccaaaggacagtattatctatttaactgcagattctcccaatgttatgactactttcaggcatgacaaagtttatgtaattgggtcttttgttgataagagtatgcagccaggcacatccctagccaaggcaaaacggctgaacctggcaactgaatgccttccattagataaatatttacaatgggaaattggtaacaaaaatctcaccttagatcaaatgatacgtattttgttatgtctgaaaaacaatggtaattggcaagaggctctgcaattcgttcccaagagaaaacatactggttttctggagatttctcagcattctcaagagtttatcaacagactaaagaaggcaaagacttaattcattttcaaaaggttctctgaatgtgcacagaacacgtggctcaaatgagaacatttgatggcttaaaaagtaaatgcgttagaaatacagttctgttaatgtatttcttcccaaacaattcatttttctcttctaaaggtagtctttcccaactgactgtagggttgtgtcttttcccaattaaatatctgcagaactttgggattatactttgtttactgtagaaagataataaaaagagttgtccaa

SEQ ID NO: 33375 - DNA, 706 bp, Homo sapiens
ctagtgaccatgcgttggccgccggtatcaagaaaaatgggacaaattgcttttaacatcaacagaaaagtctcatgtagatttatttccaaaggacagtattatctatttaactgcagattctcccaatgttatgactactttcaggcatgacaaagtttatgtaattgggtcttttgttgataagagtatgcagccaggcacatccctagccaaggcaaaacggctgaacctggcaactgaatgccttccattagataaatatttacaatgggaaattggtaacaaaaatctcaccttagatcaaatgatacgtattttgttatgtctgaaaaacaatggtaattggcaagaggctctgcaattcgttcccaagagaaaacatactggttttctggagatttctcagcattctcaagagtttatcaacagactaaagaaggcaaagacttaattcattttcaaaaggttctctgaatgtgcacagaacacgtggctcaaatgagaacatttgatggcttaaaaagtaaatgcgttagaaatacagttctgttaatgtatttcttcccaaacaattcatttttctcttctaaaggtagtctttcccaactgactgtagggttgtgtcttttcccaattaaatatctgcagaactttgggattatactttgtttactgtagaaagataataaaaagagttgtccaa

SEQ ID NO: 33376 - DNA, 377 bp, Homo sapiens
tgtgtttcaaaaattgattttattttgctatttcaaatttatacttgcacaattagttgagaagttataaaaatctttgtctaatttttaattgcatttttcttcttttacaggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtggaaaactaccatgaaatctagtgtgcaagaagaatgtgtttcaacaatctcaagc

SEQ ID NO: 33377 - DNA, 1835 bp, Homo sapiens
cggctgagccccagcgaccgctctggtcggctgtgtagactgttgggtaggctgcgtgctagcttcggcgcggatccctgggcgtccgtacgtcggagtccttcgtcctccagggtccctgttctttgcgccagcgggaaccactatctctgcactcctggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtggaaaactaccatgaaatctagtgtgcaagaagaatgtgtttcaacaatctcaagcagtaaggatgaagatcctctagctgccaccagagagttcattgagatgtggagattgcttggcagagaagtaccagaacacatcactgaagaagagctcaaaacccttatggaatgtgtttctaacacagcaaaaaaaaaatatttaaaatatttatatacgaaggaaaaagtgaaaaaagctaggcaaataaaaaaggaaatgaaagcagcagcaagggaagaagcaaaaaatatcaagctgctagaaaccactgaggaagataaacagaaaaactttctatttttacgactttgggataggaatatggacatagcaatgggctggaagggtgcccaggccatgcagtttggacaacctttggtttttgacatggcttacgaaaattatatgaaacgaaaagaattgcagaatactgtttcccagcttttagaaagtgaaggatggaacagaagaaatgttgatcctttccatatttatttctgcaatctaaaaatagatggtgctttgcacagagagttagttaaacggtatcaagaaaaatgggacaaattgcttttaacatcaacagaaaagtctcatgtagatttatttccaaaggacagtattatctatttaactgcagattctcccaatgttatgactactttcaggcatgacaaagtttatgtaattgggtcttttgttgataagagtatgcagccaggcacatccctagccaaggcaaaacggctgaacctggcaactgaatgccttccattagataaatatttacaatgggaaattggtaacaaaaatctcaccttagatcaaatgatacgtattttgttatgtctgaaaaacaatggtaattggcaagaggctctgcaattcgttcccaagagaaaacatactggttttctggagatttctcagcattctcaagagtttatcaacagactaaagaaggcaaagacttaattcattttcaaaaggttctctgaatgtgcacagaacacgtggctcaaatgagaacatttgatggcttaaaaagtaaatgcgttagaaatacagttctgttaatgtatttcttcccaaacaattcatttttctcttctaaaggtagtctttcccaactgactgtagggttgtgtcttttcccaattaaatatctgcagaactttgggattatactttgtttactgtagaaagataataaaaagagttgtccaagattgttgaacagaataatctttatcccagttaaatagttgtaccattggtagacttttttatggaggttcctagagggtggtgccctggggtgggcttggaagctctgcaccccttcccccatagctttccccgtgcatctctttgtctgtatgttttgtaatatcttttacagtaaactggtaaatgtgtttccttc

SEQ ID NO: 33378 - DNA, 1582 bp, Homo sapiens
cggctgagccccagcgaccgctctggtcggctgtgtagactgttgggtaggctgcgtgctagcttcggcgcggatccctgggcgtccgtacgtcggagtccttcgtcctccagggtccctgttctttgcgccagcgggaaccactatctctgcactcctggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtggagtaaggatgaagatcctctagctgccaccagagagttcattgagatgtggagattgcttggcagagaagtaccagaacacatcactgaagaagagctcaaaacccttatggaatgtgtttctaacacagcaaaaaaaaaatatttaaaatatttatatacgaaggaaaaagtgaaaaaagctaggcaaataaaaaaggaaatgaaagcagcagcaagggaagaagcaaaaaatatcaagctgctagaaaccactgaggaagataaacagaaaaactttctatttttacgactttgggataggaatatggacatagcaatgggctggaagggtgcccaggccatgcagtttggacaacctttggtttttgacatggcttacgaaaattatatgaaacgaaaagaattgcagaatactgtttcccagcttttagaaagtgaaggatggaacagaagaaatgttgatcctttccatatttatttctgcaatctaaaaatagatggtgctttgcacagagagttagttaaacggtatcaagaaaaatgggacaaattgcttttaacatcaacagaaaagtctcatgtagatttatttccaaaggacagtattatctatttaactgcagattctcccaatgttatgactactttcaggcatgacaaagtttatgtaattgggtcttttgttgataagagtatgcagccaggcacatccctagccaaggcaaaacggctgaacctggcaactgaatgccttccattagataaatatttacaatgggaaattggtaacaaaaatctcaccttagatcaaatgatacgtattttgttatgtctgaaaaacaatggtaattggcaagaggctctgcaattcgttcccaagagaaaacatactggttttctggagatttctcagcattctcaagagtttatcaacagactaaagaaggcaaagacttaattcattttcaaaaggttctctgaatgtgcacagaacacgtggctcaaatgagaacatttgatggcttaaaaagtaaatgcgttagaaatacagttctgttaatgtatttcttcccaaacaattcatttttctcttctaaaggtagtctttcccaactgactgtagggttgtgtcttttcccaattaaatatctgcagaactttgggattatactttgtttactgtagaaagataataaaaagagttgtccaa

SEQ ID NO: 33379 - DNA, 324 bp, Homo sapiens
acccaccatcttatgaagtggaagattaagcacacttctctcaattattgatatgtcgagcaggtgaatagtaaagaatggaagattaaacaataccatttacatgcctgataaatagacatatactatccatacttagcaaaaaagcattcttctcaagcacttttgtgaaaattgactacatactagtccaagaagtaatatcaacaaatttcaaaagtaacgtgagcaccagggcctagctttgctcccttcaatttccgcttcagcctccccagcatcccccatcttcccgcctctaggctttagtcacttgcccgctta

SEQ ID NO: 33380 - DNA, 2670 bp, Homo sapiens
tgtggtggtatgcgcctgtagtcccagctactttggaggctgaggtgggagtattgcttgagccaaggaggtcgaggctacagtgagctgtgattgagccactgcactccaatctgtgtgacagagcaagaccctgtctcaaaataataataataaaatcaaaaagagtgttaagggggtctccacttaaggagtagagagtccggggcagttctcgtatctctgtccttgtctcattttagatgtttagatatttagatattatacaaggccacccagtggtaaccaacctagaatgtgttggcctcctcttcccctcactccgtgtaggttctgtgcagcctggctgctggtggcatctcttatcatgggacattggtggggacccagccgtgcccttggtgccaagaagcctaaagggctcctgtcgcctggaaacttgagagtgcagggtcgggtgctgtgccccacaaggtgctgagcaagcccaagaagaagagtgtggggtgtggtgtgtgagttcagacctcttggagctgtgggggcatggttcccatcagctgctgttcctctgatgatgcccactgcgtgttgtgggaggcgtggccaccgtgtgatgttgtagtaggagaagggagacttaggagctagacatgatacgcaggcatcaagaggtcaaccaggtgtccacaatctgtgagccacacagagctctctttgtgcatatgcatcccaagcttcaggaaggcaacagctactagagggcctgaggacagattcttggtcgcagaagcggcattggctttagttcagccctcaccatgtttaccaacgtcacttctgtgttcccctcatgggtctcccagctcccagtctccatgccacctccacgctgagaccagaccagttttccccacacacaaatccaagcctgtcactcccctgcttgaaatccttccctgtctccctgtggccttggggtagggcctctctgctctgccacctctccagactttttgtgtgccaccgcccactcacacccacctctcaggctccaaacatgttctcttgcgtcagctcatcccttacactcgctgcttcctctgcctggccagcctcccaccttccgatctcccactcaccttttttgcctcctcatcttttgaggtctcagctcagtgtcacttcctcccgggagcctcgcctgtctcttccactccagcttggtcagtgagcagagaggcttgtgtgcttttctgtcgctgtacccataagtgtcatctgcatgtgagcatgagggccggcccattgtacccctaacaggggaggatgctcagcacttcctggatgtcgaatacctgagcgataaacaactaatgttcaggaagtgctttccaggtggcaaaaggtgtttcctctactttgaagcaagaatcttcaccaatatacatgctattttattaccccaatttactgatgaggaaactaagcttctgagacttcaagcgattttccaaggtcatgtagggatacacaagttccagcatgtgattgtggtaaaggttgtgtgtgacacatgagtgcaaccagagatgtgtataaagattgttactgggccgggcgcggtggctcacacctgtaatcccagcactttgggaggccgaggcaggtggatcacgaggtcaggagattgagaccatcctggctaacacggtgaaaccccgtctgtactaaaaatacaaaaaattagccaggcgtggcatgcgcctatagtcccagctactcgggaggctgaggcaggagaatggtgtgaacccgggaggcggagcttgcagggagccaagattgtgccactgcgctccagcctgggcgacagagcgagactccatcttaaaaaaaataataaaaggattgttattgatgaccgggtgcggtggctcatgcctgtaatcccaacactttgggaggctgaggtgggcagatcacctgaggtcaggagtttgagaccatgctggccaacatggtgaaaccctgtctctactacagatagaaaaattagctgggcatggtggtgcgcacctgtaatcccagctacttgggaggctgaggcaggagaattgcttaaacccaggaggcggaggttgcagtgagcccagatggcaccactgcactccagcctgggtgacagagcgagactcagtgccccccaaaaaaagatttttattgctgcattctctgaaatagcaaggaattaaaaactgcctgtagatacagcaattaaagtgaactccatccgcatgtaccaatatagacgaagtcctaaaaacataataactaagtgaaatgtacattgtgaaaggatagctacagtgagatacctgtacttggaaactgtaaaaacccaaaataatgctaaatgctcaggaagagacagagacacaccagcttcaaggatagtggtggcctgtggtgataggtggaagggaatgggatggggtgatggggtttttagccatatctgtatttgtattttactataaaaatacttgacataaacatgacaaaatatgaacccctggtaaatctgggcaatgagttccccaatgtctactatattattttctacctttttctgtttttcaaatagttccataattaaacatttaaaaa

SEQ ID NO: 33381 - DNA, 400 bp, Homo sapiens
aatgttgctttacataaatattctgatgcaattctaattactgattatttgcacatgacctacttttttctctctggaatattttagattcttgggtatctgataatctggaatttcatggtaagatgccttgttgtgaacctttttttattttttatttttattttttgagataagttcttgctctgtcacctaggctggagtgcagtgatgtaatcacagcttgctgcagtcttgacctcttgggctcaagtgatccttctgcctcagcctcccaagtagctgagaccgcaagcacgcaccaccacacacagctgattttttaaacttttggtccattccaagatggccgaataagaacagctctggtctgcagctcccagcgtgattgacgcagaag

SEQ ID NO: 33382 - DNA, 305 bp, Homo sapiens
gggtgacgccatgtgcttgtccctgaaaatgtgttaactctggggatgtcatcatcccatgaggccaatcacagatcattcctcccactctccttttgctttgccccaaaccatatgttccctcatgacacacctacgcttccccaccctgaccccctgccatctcctcccaccaaaagcatgttctaaatattagctttttttttccccacaagagaaaagcattgcactagtttctctacatcattttatgaaacccttacagaaatcctaaaagataggcattcttatccctattttcagaa

SEQ ID NO: 33383 - DNA, 147 bp, Homo sapiens
tagtgtgctgctctaacagaggggctttgtgctacagcttcttccagagctccacagatgcatgctgggcgggctcagtcagctttacccctaatacacttgcttcttcctaacaatagcagagcaagactgacaacaataattaaa

SEQ ID NO: 33384 - DNA, 344 bp, Homo sapiens
tcaaacttctctcattcctctaaatgtacaaaggtttcaaagttgtaaaaaatatgtctacatagccaatgctcttagtatttttaacagcaaagataatctctgccaataattattaatgacaaaatagtgataactgttcaatgttgctttaacagtccaattgtagtaggtgagaaaacaaaaaagaagagaagctatgttgaatatttagtaatgttgggaaaagatcctcaccctaggacataaaatagtttaaacattttaaacatgggcccctctcttattgtcattgctagtggaaggagttcctgaaattgcatattacattgtaaagttttggg

SEQ ID NO: 33385 - DNA, 342 bp, Homo sapiens
tttttgagacagaattttgctcctgttgcccaggcgggagtgcaatggcgcaatctcggctcaccgtaacctctgcctcctgggttcaagcgattctcttacctcggcctcccaaatagctgggactacaggtgtgcgcccactacgcctggctaattttgtatttttagtagaaacggggtttcaccatgttggtcaggctggtctcgaactcctgacctcaggtgatccgcccacatgggcctcccatgaatttttacctataaaatgaaatcaaagaaaggtacagcagggagaaaccagctggctctgtgtgatataatcccatgagaaacaacatac

SEQ ID NO: 33386 - DNA, 333 bp, Homo sapiens
taaaaaacacacaaccatttacatgaacaccaaaattttgaaaacttaggtatggattgaaagtataagatctgtatgaggaagattacaaagctctgatgaaaaaaaattacagaaataaatacggaaatattttgtgttcatggatagggaaatgtattctttatcttaattgctgattagtactaagtacaattaagatcagtaaacatcttgtgtactattaagatgtcagttttcttccaacttgatctatagtttcaatgcactacaaatcaaaccactagcaaattagtttgtggatatcaacaaattgattctaaaagtatagga

SEQ ID NO: 33387 - DNA, 329 bp, Homo sapiens
atgacaactaaagttgtggaggaagtgcagcaacataaactcttaatatactggtagtgtataagattttcaaccattttggaaaagtatctggtagtttcctacaaagcaccataatgcagctaggtatttactaaagagtgaaaatacatgtttacaaaactacttgtacaaggatatttagaaagctttataggtaagagtcaaagactagaaactaccaagtgttcattaatagaataattgatttaaaaattatagtatattcataaaacgcaatgcaataatacattcagtaataaaatcaacaatgatcaagactctatctc

SEQ ID NO: 33388 - DNA, 396 bp, Homo sapiens
cctccctgcagctctgagtggcaacgagcaggaaaagcagctcacagagcagcctccaggcaccaagaccgtgaggccacatcgcctccagggagcaggtcccacagcacccctaccccagggcaccaggactgggttattccgggatttcgcagtgctgagaactttggagaacaaaatccccggcagctgcctgaacgctgaacggaggtggcgcgatccgcctgatgaatcaggctaattacacagaagccacacaggttttgcttcctccaggaaaactgctttccctctttaatattcactatcctcttctcacagcctgtaagcctcgctcaaattagggtgcagctgcaacccaaacccaaaataaaatgcccaagcacgcgacaggga

SEQ ID NO: 33389 - DNA, 677 bp, Homo sapiens
aaatcatgataatggttccctgtttatgaggttgtcataggagcctacaaagttgtatgtgcaatggcactgtgtgatgtataaaacagtaacatggaaatgcaaggtgatgtaactggtataatcactgaaataccattgtttcagtgtctgttgtcttttctctggtgctgcaatgtgtggtggctacgaggaaaaaggaagatttgaacttgtgccagtcacaatttttgtgttggcccttcacttagaaatttatttgcaaatgcttcctcaagtaggaaggccatgatgagagagaccatgcctaatccttcagcttagacgtgacacagacatgtaacttcattttaaaaatgtctctgctggtaatatgacttcaaatttaaaataagtccttttggccaggtatggtggctcacacctgtaatcccaacactttgggaggccaagcagggagaatttcttgaggtcaggagtttgtgatcagcctgggcaagaccccatctctacaagaaataaaaaatcagtcaggtatggtgttgcatgccaatagtcccagtcactcaggaggttgaggtaggaggattgtttgagtttgggaggtcgaggctgtagtgagctatgatcacaccactgcactccagcctgggcaacagaatgagaccctgtcttta

SEQ ID NO: 33390 - DNA, 802 bp, Homo sapiens
cttaaaacttaaccttttaactcactggttaaaggaatccttctgtcttaaaactgcaaactttagatggagaaagttcattaaaacattcagtgtatcttgagaaatttaaggagtttagacttttaacatcttgtgccaagttctttaatttctcccttgagaaagtcagatgaaatgtattcagagttggagttacaaaatagttaatgtgtctaaatgatgtgttgtccttagactaattatctctaatatattggtgttctgtaattttctttcaattgtgaagtatctacaggctgttgacaatcagctaaagaaaaaagcaagactgtttaaagacagtaacagggccaggcgcggtggctcacgtctgtaatcccagtactttgggaggccgaggtgggcaaatcacctgaggtcaggagttcaagaccagcctaggcaacatggtgaaaccctttctctattaaaaatacaaataggccgggcttggtggctcatgcctgtaatcccagcactttgggaggccgagacaggcggatcacgaggtcaggagatcgagaccatggtgaaaccttgtctctactaaaaatacaaaaaaaattagctgggtgcggtggtgggtgcctatagtacaggtcgacgcggccgcgaaattatatagtaggcgacccggaaattcggaccggaccctgcagggtcccactttcctataggaggcgtttaaaactcggggaaacatgggaaaacggttcccgggggaaaggttaccgttcacaatccaccaatttggaggggt

SEQ ID NO: 33391 - DNA, 277 bp, Homo sapiens
gtggctcacacttataatctcagcactttgggagtctaaggcaggaggatcacttgagcccaggagttcgagaccagcctgggcaacatagcaaggcccaatctctgtaaaaaaaattgtaaccagctgggcatggtggtgtgcatctatagtcccaccctactcaggaggctaaagcaagaggatctcttgagcccaggagtttgattctgcagtgagttatgattgcaccactgcactctagcctgggtgacagaacaagaccttgtctcaaaaa

SEQ ID NO: 33392 - DNA, 515 bp, Homo sapiens
agtgactctgtaggatccttttactgttatcgcccaacactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattcagtgttggggataacatacgggtaccg

SEQ ID NO: 33393 - DNA, 936 bp, Homo sapiens
cgagaagcgtgcggcgaggacagaggtgggctcaacaccaagaggccaccaatgaaaacgtgactttttcacattccccgccccttccgtgtgcacgctccccacgaggggctggttcctgaaaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattca

SEQ ID NO: 33394 - DNA, 862 bp, Homo sapiens
aaccataggctagtacgaggccggtgttatcggccgaggggttcctgaaaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattca

SEQ ID NO: 33395 - DNA, 862 bp, Homo sapiens
agaactagtcggacgcgtgggcgctccccacgaggggctggttcctgaaaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattca

SEQ ID NO: 33396 - DNA, 1062 bp, Homo sapiens
cgagaagcgtgcggcgaggacagaggtgggctcaacaccaagaggccaccaatgaaaacgtgactttttcacattccccgccccttccgtgtgcacgctccccacgaggggctggttcctgaaaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattcacacacattatggaggcatgctgagataatagcagaaactaggactgtttgagagaaaggatgtgtgatgaccctaattataccttctttttcagaagaaactgaatgcatagggtgaccatatatt

SEQ ID NO: 33397 - DNA, 1031 bp, Homo sapiens
cgagaagcgtgcggcgaggacagaggtgggctcaacaccaagaggccaccaatgaaaacgtgactttttcacattccccgccccttccgtgtgcacgctccccacgaggggctggttcctgaaaggatgtacagaggatccccaaccgcctgcgaaacccaagccgccgcgtaggagcgtgcgttcgggccctcttctcccacctgttcgcagcctccacgatccagctgccaaccatctagcctaccctgatctctgagcaggggtcgtcgtcattttactccagaggagactgaagccaaaagactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattca

SEQ ID NO: 33398 - DNA, 870 bp, Homo sapiens
ccagcatttttctgctttaagatcctttccatgacttccttgtttaggccagcctccacgatccagctgccaaccatctagcctaccctgatctctgagcaggggtcgtcgtcattttactccagaggagactgaagccaaaagactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattca

SEQ ID NO: 33399 - DNA, 860 bp, Homo sapiens
aaccataggctagtacgaggccggtgttatcggccgaggcagcctccacgatccagctgccaaccatctagcctaccctgatctctgagcaggggtcgtcgtcattttactccagaggagactgaagccaaaagactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattca

SEQ ID NO: 33400 - DNA, 1144 bp, Homo sapiens
cgagaagcgtgcggcgaggacagaggtgggctcaacaccaagaggccaccaatgaaaacgtgactttttcacattccccgccccttccgtgtgcacgctccccacgaggggctggttcctgaaaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtactggctaacaaataacaaacacccacacacacaaccacacccaccaccaacactcaacacaccaccaccctcaaaccccacaccgccccacacacaacccacccccacatcacccccctcacccccccacccccccacgtacaccgagaggagaaaggtaggaaaagagaaggacgagcccagaggagaggagaagaagggtagcggaacccctcttaacacaggcatataaagcgagaaaaaataacgaggaagcaacgccacacaccggccgcgaacacaataataggtcaacagacatagatac

SEQ ID NO: 33401 - DNA, 1032 bp, Homo sapiens
cgagaagcgtgcggcgaggacagaggtgggctcaacaccaagaggccaccaatgaaaacgtgactttttcacattccccgccccttccgtgtgcacgctccccacgaggggctggttcctgaaaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaaaaaaaaatatcatactaaaagagaagggctaaattttaaaaataatagaaaaaaccctttagggggggcccggttccaaattcgccctatggggagttgtttaacaattaactggccctcgttttacaaacttctggactgggaaaccccgggtgtttcccaacttaaaatgctttgtagaaaatcccccttt

SEQ ID NO: 33402 - DNA, 571 bp, Homo sapiens
cgagaagcgtgcggcgaggacagaggtgggctcaacaccaagaggccaccaatgaaaacgtgactttttcacattccccgccccttccgtgtgcacgctccccacgaggggctggttcctgaaaggatgtacagaggatccccaaccgcctgcgaaacccaagccgccgcgtaggagcgtgcgttcgggccctcttctcccacctgttcgcagcctccacgatccagctgccaaccatctagcctaccctgatctctgagcaggggtcgtcgtcattttactccagaggagactgaagccaaaaggtggtgagaggagagtacagcagcatttactgagtcctatagtagcccaagcgcttttcattcgttatattaatcttcattctaattgtgcgaattaaatattattaatgggaaaactaaaatgaaaaagatacatagtaaggcgtagtgctgggatttgaacacggatctcttggtttaggatcaaggcactttctattccactgttctttctctaaattatttgctcctggccctatttaaagagtatatccagtgtatttagg

SEQ ID NO: 33403 - DNA, 664 bp, Homo sapiens
cgagaagcgtgcggcgaggacagaggtgggctcaacaccaagaggccaccaatgaaaacgtgactttttcacattccccgccccttccgtgtgcacgctccccacgaggggctggttcctgaaaggatgtacagaggatccccaaccgcctgcgaaacccaagccgccgcgtaggagcgtgcgttcgggccctcttctcccacctgttcgcagcctccacgatccagctgccaaccatctagcctaccctgatctctgagcaggggtcgtcgtcattttactccagaggagactgaagccaaaagggtctcccgctgtaacccaggctggaatgcagtggcgtgatcacggctcacagtgttgcccaggctgggcgcaaaccatcctcccgcctcagcctcccagtgttgggattacaggcgtgagccatggcacccggcttcatctctgtgcttccagagaggttattaaatgatgtgtccaagggcaccaaatgaggcagtgacaaagctaggtccaagtctgtttcaaagcccattttctccctcttgcttaagttataccgcctccaaggcaaatgagttgtgtaaagtgcctaactccctcttgtgattccccattgccctcagaataaaaagtcttaaactccctactatgtcctaca

SEQ ID NO: 33404 - DNA, 1131 bp, Homo sapiens
  misc_feature (1131)..(1131): n is a, c, g, or t
cgagaagcgtgcggcgaggacagaggtgggctcaacaccaagaggccaccaatgaaaacgtgactttttcacattccccgccccttccgtgtgcacgctccccacgaggggctggttcctgaaaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtacacacacaccggtcagcaccgaccgacacacaacaggagagggcgccgctcaaaaaaattccccgcgaggcccaatgagcgctacccgtttctgaacgagggcccagagggcgcgactaaacaggcggggcgcggtgaaggccgagggaacgggcctggaccggcagcccactggggcggcaaggacgcaccgagtgcggaaacacggtcaggcccgcgtccgaagccgttatacgccactggaacgcgcctccctccacacgctgcaccgccacaccagcgccatcgccacgn

SEQ ID NO: 33405 - DNA, 1254 bp, Homo sapiens
caaccagttatttgggagccgaggcagatggatcataaagtcagaagttcagaccagcctggctgggatgatgaaaccccatctctactaaaaatacaaaaattaggcgggcgtgatggcaggcacctgtaatcccagcattttgggtggctaaggcaggaggatcacttgagcccaggagtttgagaccatgctgagcaacatggaaaaaccttgtctctattaaagaatcaaaaaaattagctgagtggtgatgcacacctgtagtcccagctactctggccagggagggactgagggggaaggattgcttgatccctaaagatggaggctacagtgagcctgggcaacaaagcaagacaccctcaaaaaaaaaaaaaaaaaaacaagcatctgtcttcaagcttagagtctcccacgggagacagacacattaaacaggctaaatggtgcagtctggtcagtgctatttataatttaggaaccttacatattatatccctactctaacctgttaatgttctatagactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattca

SEQ ID NO: 33406 - DNA, 1169 bp, Homo sapiens
taatttctcattccatatatattaggaatgtctttccatgtcacatacacttcagtgtttttctcattccattagaaatgttatatgtatatttcttgattgaagaaataaccataaagttatatgctcattgtaaaaatactcaaatccaaacagtgcagaaatgtatagcaaaggaaggaaaaattttactgaattccacccttgagacctaatttagcggtattgctaaatttcatcttcacatttttctgtgcacagactggacatatagatgcattttttcttctgcaaagtggacccatctacggtttggcagttttctttttcccttcctgtattcctgtagtgtggacatcttttcctgtcggtacatgaggctctaaggcatctttcttccagtcctgggaaaaggaacatttggcttgaaggatcctcggaaggagggactgcccctcaggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33407 - DNA, 452 bp, Homo sapiens
cccacactagcctcctaaagcgacacatctctcatcagacgtctgtgaatgcagaccccgctccccacaatgaaataaagttattttctcattcccaaaaaaaaaaaaaaaaaaaacgaaggcggccgcttctttcaagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33408 - DNA, 2504 bp, Homo sapiens
cacggcactgcatcccccaacacgtgtagaaacttagagaatgccagttattaaaataacccttatgataacaccaattcgatgcagaagtcttttaaatatcataagcctcgtcgttttattccacatggttttctaggtaaccaaattctaggaggtgcgttgcagggccatcttcgcatcccggccatgcccagcaggacggtgttctctaaacggcgctgatgcccgatttcgaccccgaggagactgcggacctcgactgcggcccccaccagggccggtccgccctcactccaccctctgaggctggggcggagtcgaccggccggccccgagaccccttgccttaccggtggagcaaggaaccggaagccgcggctcttacataaccgggatgatgtcagggcgggcgactcccggggggcgggaccagggcggaggccgcgccgggagcgcggtggggctaggcgtggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgaggtggcacagttcacctggtttgtcgagatcaagccccagcagaagatgccaggggtgagatcatccgggagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33409 - DNA, 2171 bp, Homo sapiens
agcggggtgtcgaatggcgctcccgcgaatctttccaggctcagtctgaggggcgcgcggagactgtctcttggaaccgaacgcctcgagttgcttgcgccaggggaggacgtcgccccagaagtctcagctctacagaacgtggttattggagattcgtggtcgatagtgatgaggtacttgtgatacacaatcgatgcatctctgtggagagatcgctcgattttcgcatcgtggagatgaagacttcttgtagcagaggtacagctgtgatgagaccacacgtctggcgattgtgtggcaggttgtcatctcgcctatttgattactcagacaagcagtagcgtggcacagttcacctggtttgtcgagatcaagccccagcagaagatgccaggggtgagatcatccgggagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33410 - DNA, 2736 bp, Homo sapiens
cacggcactgcatcccccaacacgtgtagaaacttagagaatgccagttattaaaataacccttatgataacaccaattcgatgcagaagtcttttaaatatcataagcctcgtcgttttattccacatggttttctaggtaaccaaattctaggaggtgcgttgcagggccatcttcgcatcccggccatgcccagcaggacggtgttctctaaacggcgctgatgcccgatttcgaccccgaggagactgcggacctcgactgcggcccccaccagggccggtccgccctcactccaccctctgaggctggggcggagtcgaccggccggccccgagaccccttgccttaccggtggagcaaggaaccggaagccgcggctcttacataaccgggatgatgtcagggcgggcgactcccggggggcgggaccagggcggaggccgcgccgggagcgcggtggggctaggcgtggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgaggtggcacagttcacctggtttgtcgagatcaagccccagcagaagatgccaggggtgagatcatccgggagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctggtgtggacatcttttcctgtcggtacatgaggctctaaggcatctttcttccagtcctgggaaaaggaacatttggcttgaaggatcctcggaaggagggactgcccctcaggtggccacttgccctcttgtggggggcgggtgcgggcagacagtccccacatcagtcctgcaggaccccttgagttggggcttcctgcagccccctcatgggatgctgtgtgctgcctcaggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33411 - DNA, 2615 bp, Homo sapiens
cacggcactgcatcccccaacacgtgtagaaacttagagaatgccagttattaaaataacccttatgataacaccaattcgatgcagaagtcttttaaatatcataagcctcgtcgttttattccacatggttttctaggtaaccaaattctaggaggtgcgttgcagggccatcttcgcatcccggccatgcccagcaggacggtgttctctaaacggcgctgatgcccgatttcgaccccgaggagactgcggacctcgactgcggcccccaccagggccggtccgccctcactccaccctctgaggctggggcggagtcgaccggccggccccgagaccccttgccttaccggtggagcaaggaaccggaagccgcggctcttacataaccgggatgatgtcagggcgggcgactcccggggggcgggaccagggcggaggccgcgccgggagcgcggtggggctaggcgtggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgaggtggcacagttcacctggtttgtcgagatcaagccccagcagaagatgccaggggtgagatcatccgggagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctggtgtggacatcttttcctgtcggtacatgaggctctaaggcatctttcttccagtcctgggaaaaggaacatttggcttgaaggatcctcggaaggagggactgcccctcaggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33412 - DNA, 2475 bp, Homo sapiens
cacggcactgcatcccccaacacgtgtagaaacttagagaatgccagttattaaaataacccttatgataacaccaattcgatgcagaagtcttttaaatatcataagcctcgtcgttttattccacatggttttctaggtaaccaaattctaggaggtgcgttgcagggccatcttcgcatcccggccatgcccagcaggacggtgttctctaaacggcgctgatgcccgatttcgaccccgaggagactgcggacctcgactgcggcccccaccagggccggtccgccctcactccaccctctgaggctggggcggagtcgaccggccggccccgagaccccttgccttaccggtggagcaaggaaccggaagccgcggctcttacataaccgggatgatgtcagggcgggcgactcccggggggcgggaccagggcggaggccgcgccgggagcgcggtggggctaggcgtggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgaggtggcacagttcacctggtttgtcgagatcaagccccagcagaagatgccaggggtgagatcatccgggagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagggaagtcaaccacatttgctggagaatgctgtcctaatccgcctgacccttccttctcccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33413 - DNA, 1552 bp, Homo sapiens
agccccacctcagacttctgggctccagaaccataggagaatacatataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33414 - DNA, 1991 bp, Homo sapiens
taatttctcattccatatatattaggaatgtctttccatgtcacatacacttcagtgtttttctcattccattagaaatgttatatgtatatttcttgattgaagaaataaccataaagttatatgctcattgtaaaaatactcaaatccaaacagtgcagaaatgtatagcaaaggaaggaaaaattttactgaattccacccttgagacctaatttagcggtattgctaaatttcatcttcacatttttctgtgcacagactggacatatagatgcattttttcttctgcaaagtggacccatctacggtttggcagttttctttttcccttcctgtattcctgtagtgtggacatcttttcctgtcggtacatgaggctctaaggcatctttcttccagtcctgggaaaaggaacatttggcttgaaggatcctcggaaggagggactgcccctcaggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33415 - DNA, 1215 bp, Homo sapiens
gaatacaatgtgttgcttcaagccactaattttgtggtcattggtcacaacagcaagaagcactgctctacagggggtgaagagtggaaggggtcacaggctttagtttgtaaatctctgttacctttattgcagataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33416 - DNA, 2421 bp, Homo sapiens
cacggcactgcatcccccaacacgtgtagaaacttagagaatgccagttattaaaataacccttatgataacaccaattcgatgcagaagtcttttaaatatcataagcctcgtcgttttattccacatggttttctaggtaaccaaattctaggaggtgcgttgcagggccatcttcgcatcccggccatgcccagcaggacggtgttctctaaacggcgctgatgcccgatttcgaccccgaggagactgcggacctcgactgcggcccccaccagggccggtccgccctcactccaccctctgaggctggggcggagtcgaccggccggccccgagaccccttgccttaccggtggagcaaggaaccggaagccgcggctcttacataaccgggatgatgtcagggcgggcgactcccggggggcgggaccagggcggaggccgcgccgggagcgcggtggggctaggcgtggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33417 - DNA, 1840 bp, Homo sapiens
cacggcactgcatcccccaacacgtgtagaaacttagagaatgccagttattaaaataacccttatgataacaccaattcgatgcagaagtcttttaaatatcataagcctcgtcgttttattccacatggttttctaggtaaccaaattctaggaggtgcgttgcagggccatcttcgcatcccggccatgcccagcaggacggtgttctctaaacggcgctgatgcccgatttcgaccccgaggagactgcggacctcgactgcggcccccaccagggccggtccgccctcactccaccctctgaggctggggcggagtcgaccggccggccccgagaccccttgccttaccggtggagcaaggaaccggaagccgcggctcttacataaccgggatgatgtcagggcgggcgactcccggggggcgggaccagggcggaggccgcgccgggagcgcggtggggctaggcgtggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccagacaggaatgagcaggagctgaggaaggtagtgggagaggcccagactgcctcaccactccccaggtttttggaaataatgatgcatgaaggtaaatgccagccacaaggacacagctcgaatgatctggaagcgtgttggagcagcggtggaggggagcagaattctcttccggattggcctcaccaactccatgacctcaggcagctcacctgggctctctgcagctctttcctcctctacaaacaagggaactgaaagcagcagcagccacagcacacaccccagggtgcacccgcggcgccaagaactggtctcagcgctgtctgcggattaacgcatttgtcctcaagcctctgtggagtggccactactgtctattatcacacccatttacagatgagggaactgaggcccagagaggctaagacctcccagccgggcctggccatggggttttgggaatcaggctctcacacactgctggcatggcctttctgaaaatcactatttatcagaagccttggaattcatcctaagaaataaagatagggaaaacaaggttgcttatcacagtgctggtggtaggagatgaagttaataaattatagaacacctgtgcaaaatctgttcagggctgaagactctgctgccaatcatgcctatggaaaaaccctgtgtgcactatatcattaaatgaagataccaagttcctgaataaaaaaaaact

SEQ ID NO: 33418 - DNA, 797 bp, Homo sapiens
cacggcactgcatcccccaacacgtgtagaaacttagagaatgccagttattaaaataacccttatgataacaccaattcgatgcagaagtcttttaaatatcataagcctcgtcgttttattccacatggttttctaggtaaccaaattctaggaggtgcgttgcagggccatcttcgcatcccggccatgcccagcaggacggtgttctctaaacggcgctgatgcccgatttcgaccccgaggagactgcggacctcgactgcggcccccaccagggccggtccgccctcactccaccctctgaggctggggcggagtcgaccggccggccccgagaccccttgccttaccggtggagcaaggaaccggaagccgcggctcttacataaccgggatgatgtcagggcgggcgactcccggggggcgggaccagggcggaggccgcgccgggagcgcggtggggctaggcgtggggcgctcccggcatgtccctgtaccgcagcgtcgtgtggttcgccaaggggctgcgcgagtacaccaagtaaggcggcgcggcggggcgcggggccccgggctgtcacgtggcccgcctcggcgcgggcgagcagggttggcggggacgcgcccgcggctccttcgccctctcgctgggccgactaagcgtgtccagaacgacgggtgcgcccgccgtctagcgacccacggctgggcgtggggcagtcgccagactccagccgctcaatgcccgcgaccgagactggcgcccgaggggcggggctgtggcgcgcccaagc

SEQ ID NO: 33419 - DNA, 2570 bp, Homo sapiens
cacggcactgcatcccccaacacgtgtagaaacttagagaatgccagttattaaaataacccttatgataacaccaattcgatgcagaagtcttttaaatatcataagcctcgtcgttttattccacatggttttctaggtaaccaaattctaggaggtgcgttgcagggccatcttcgcatcccggccatgcccagcaggacggtgttctctaaacggcgctgatgcccgatttcgaccccgaggagactgcggacctcgactgcggcccccaccagggccggtccgccctcactccaccctctgaggctggggcggagtcgaccggccggccccgagaccccttgccttaccggtggagcaaggaaccggaagccgcggctcttacataaccgggatgatgtcagggcgggcgactcccggggggcgggaccagggcggaggccgcgccgggagcgcggtggggctaggcgtggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgaggtggcacagttcacctggtttgtcgagatcaagccccagcagaagatgccaggggtgagatcatccgggagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgaagggacttggcagctgcagttcagttcaaggccttgggatgagaagcgtgtcctggagtatccagataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33420 - DNA, 2028 bp, Homo sapiens
taatttctcattccatatatattaggaatgtctttccatgtcacatacacttcagtgtttttctcattccattagaaatgttatatgtatatttcttgattgaagaaataaccataaagttatatgctcattgtaaaaatactcaaatccaaacagtgcagaaatgtatagcaaaggaaggaaaaattttactgaattccacccttgagacctaatttagcggtattgctaaatttcatcttcacatttttctgtgcacagactggacatatagatgcattttttcttctgcaaagtggacccatctacggtttggcagttttctttttcccttcctgtattcctgtagtgtggacatcttttcctgtcggtacatgaggctctaaggcatctttcttccagtcctgggaaaaggaacatttggcttgaaggatcctcggaaggagggactgcccctcaggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33421 - DNA, 1641 bp, Homo sapiens
gaatacaatgtgttgcttcaagccactaattttgtggtcattggtcacaacagcaagaagcactgctctacagggggtgaagagtggaaggggtcacaggctttagtttgtaaatctctgttacctttattgcagataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33422 - DNA, 1756 bp, Homo sapiens
cacggcactgcatcccccaacacgtgtagaaacttagagaatgccagttattaaaataacccttatgataacaccaattcgatgcagaagtcttttaaatatcataagcctcgtcgttttattccacatggttttctaggtaaccaaattctaggaggtgcgttgcagggccatcttcgcatcccggccatgcccagcaggacggtgttctctaaacggcgctgatgcccgatttcgaccccgaggagactgcggacctcgactgcggcccccaccagggccggtccgccctcactccaccctctgaggctggggcggagtcgaccggccggccccgagaccccttgccttaccggtggagcaaggaaccggaagccgcggctcttacataaccgggatgatgtcagggcgggcgactcccggggggcgggaccagggcggaggccgcgccgggagcgcggtggggctaggcgtggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgaggtggcacagttcacctggtttgtcgagatcaagccccagcagaagatgccaggggtgagatcatccgggagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctggtgtggacatcttttcctgtcggtacatgaggctctaaggcatctttcttccagtcctgggaaaaggaacatttggcttgaaggatcctcggaaggagggactgcccctcaggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcacccctcgtgccgaatt

SEQ ID NO: 33423 - DNA, 1377 bp, Homo sapiens
cacggcactgcatcccccaacacgtgtagaaacttagagaatgccagttattaaaataacccttatgataacaccaattcgatgcagaagtcttttaaatatcataagcctcgtcgttttattccacatggttttctaggtaaccaaattctaggaggtgcgttgcagggccatcttcgcatcccggccatgcccagcaggacggtgttctctaaacggcgctgatgcccgatttcgaccccgaggagactgcggacctcgactgcggcccccaccagggccggtccgccctcactccaccctctgaggctggggcggagtcgaccggccggccccgagaccccttgccttaccggtggagcaaggaaccggaagccgcggctcttacataaccgggatgatgtcagggcgggcgactcccggggggcgggaccagggcggaggccgcgccgggagcgcggtggggctaggcgtggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgaggtggcacagttcacctggtttgtcgagatcaagccccagcagaagatgccaggggtgagatcatccgggagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagggcgcccacattgtctgtaaggctgccagcaccctccgccttccttgtcgctgctgtgtgccttccgaaggtggccctgtctgagactctctgcacctccacttcttctgtttatatgccctgggtgtgccccagttttgctccttgaccccagaccaaatcctggtgaattacatttcatgactccaaatcctgacatttgaaagacctgcacttttttacagttttcccagaggacatgggaataaaccatccccttgtaaatgagaaaaaa

SEQ ID NO: 33424 - DNA, 596 bp, Homo sapiens
tattccaacagagatcctaattcttttccctcttatttaaacttggaattatcaaaatcacagttttaaaaatattttatttaggatatccacatgcaaaagaatgaaattggaccttggtcttacaacatgcacaataatcaactcaaaatggagtacacaatgttagaaagacctaatgccataaaacaaaggaaacaacaaaatggaaaggcaacttgtggaataggaaaaactatttataaactgtatatccagtaaggagtttaatatccaaaatatataaggaactcatacaacacaataacttttttaaaaaatgggcaaaggacctaaaaagacatttttccaaagaacacatgcaagtggccaataagtaaaaaggtgttcaacaccgctaaccattagggaaatgaaaatcaaaaccacaatgagatatcacatcacaactgttaggatggctattaccagaaagtcaaaagacaacaagtgttggcaaggatgtagagaaaagcgaacctttgtgcactattggtggaaatgtaaattggtatagctattatggaaaacagtatggaatttcctcaaaaaataaa

SEQ ID NO: 33425 - DNA, 383 bp, Homo sapiens
attaaataaaatatatttttaaaaaatgaagcaatttggccaggtgtaggaagtatcttatgtaggaagtatggagtaataaaaaatgaagcaatttggctgggtgcagtggctcatgcctataatcccagcacgttgggagcctgaggatcgcttgagctcaggagttcaagaccagcctggcaacatgatgaaaccccctctctaccaaaaaaaaccaaaaacttagcctgacttggtagtgcgtgtctgtggtcctagctcctctggaggctgaagtggcaggatcggttgagcccagggggtggaggttgcagtgagctgagatccggctgctgtactccaccccaggtgacagagtgagactctctcaaaaagaaggg

SEQ ID NO: 33426 - DNA, 1710 bp, Homo sapiens
gggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaaggtgggcattacacagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgccaagc

SEQ ID NO: 33427 - DNA, 395 bp, Homo sapiens
ttgtgtggacgtttccatttcttcagaatatttacctgggggtggaattgctgggtcacgtggtgacaacttttttgaggaactaccagactgttttccaaagcagttgcatcattttacattcccaccagcagtgtatgagggttccagtttctccacatcctcaccagcactcattgctggctctttgttttttgttttttttttaaatgaaatgtatactccgatgccatgtttattttcatttctcctgacctctatcaagaatgatgccgtctcacctgggtgcagtggctcacgcctataatcccagcactttgagaggctgaagcaggcggatcacctgaggtcaggagttagagaccagcctggccaacatggcaaaccctcatctc

SEQ ID NO: 33428 - DNA, 336 bp, Homo sapiens
gggtgtctcaggggtggcagagacagaaaaaaccggcatacacatgagcccgcgtagtttaagcacatgtagtccaagggcttattgtgtatctgcaacaatcagatatctctgacagatgaacctgataaagtcacactatttagagtatgataccatttatgttaaaaacaaaatactatatatgtgtgcataaacctacagaaaatttcctagagaggaacaactctggagagtggtatgagatcacggaggagtaaataggatttatgccttttacgttttacacttgtgtttttgaaatattatagaaatatatttgtatattgattgttt

SEQ ID NO: 33429 - DNA, 464 bp, Homo sapiens
aaaataatttgatataattcaacatttcttcatgataaaaaaactcttcagtagactatgaataataggttgggatatcaaagccctatcacaaggtaattaatggcaaaatattagaagcattatcttaaaagtgaagacagcagctctcatcgctggaagaagagccattggttgtatgccaaggaaagcaatgtggctagatctctgttttgaaaggagtttcctgtaggcactgtattgtggaggggaggcttttaaaatgctgactatgcctaatgtatttgagaatatccacctatgaatttctaaaaatgcttatctagaaaacatttcttaaaggaaaaaaacctcagctttttggttttctacagaaaaccaaagctagtcaggaatgcaaaggtggcttctgaatgctacagagttgcagttgttcacccacaggcggcaattgacacacccta

SEQ ID NO: 33430 - DNA, 759 bp, Homo sapiens
catttttaaacgaatcaccttttacgttcacttatatgccaatacttacagttaagtaaaaaaaaaaattgaaaaatttattattgccattcaccatatttaaaaaataaagaacagaggcagaccagtctttagaaaattaaaattaaatattaaaaggagaaaaattacatgatatcaagatttagactaaagcattctgtaaaattcaacacctatttatgttctaaaacaaaacaaaaccctttacaaactagtaatagaagggaactttcttaacctatcaattctatagcatataaaacacctagtcatgacatgtattttttttaatccctttaaaaatcaagaataaaactaggaatatataattacttctattcaacattatactggtggaaatcctacccaacattttacttgcaaatgacatgatcatgtatagaaaatatcacaggacatgtacaaaaaaagccgttagagagccaggcgcggtggctcatgcatgaaatcccagcactttggcaggccgaggtgggtggatcacgaggtcaagagatcgagaccatcctggccaacacggtgaaaccccatctctactaaaaatacaaaaattagctaggcatggtggcgcacgcctgtagtcccagctacttgggaggctgaggcaggagaatcacttgaacctgggaggcagaggttgcagtgaaccaagattgagccactgtactccagcctggcaatagagcaagactccat

SEQ ID NO: 33431 - DNA, 89 bp, Homo sapiens
gcaaggcctgtgaagaaggtaagtttccaagaaggaccaaggagcatgccagcaccaactgatgaactgaattacatcaggggaaaact

SEQ ID NO: 33432 - DNA, 601 bp, Homo sapiens
aatagaatattgttttcctgctaaaattcaccaatgctgtccaagtaccctggatttgctataatttttgttgtggaattcagatatccagtggagttttctaactcctggggcttctgctgatgagaggaagggcatgaagctgattcagatttaagggtacagtagcagagtaattacaaacagagaacctgcaatcggcatggccagaaatatacatttcaattatggtttctaagggagaatttcataggacctgcctatgatatatctgactatatgtggcctctatggtacgttctttctttcttgggttcatgattcacatcctgctagaaaataccagaactgcacaatactttatatttgttattggcaaagtttctttttaatgttccgttggtgtagtctttacataatacattttggggggaacatttgactcatggctaaagcgaaactccaagggtataattaaccccaggggtcttctgggagcaacctgccgattgctgctgaatcgcaaaccaacatttacaaataattacaataatggttttactgaacttactcataatgatttcaatcagggcagccatct

SEQ ID NO: 33433 - DNA, 479 bp, Homo sapiens
gttatttattgagacataaacatttatgatagttgtaaatccatattttcaaatagtattctagatcatgtcaatatatttggaactcctgtcagatctgattaatcattgttttgaccttgtgaatgacaaagagccctgtgagttaagtatggtctctgccctttcttggagtactccacacacactgcttcttttcagcaacactttaggtcgtttatctgttgtgtgggtttgtttcattgtaacctgggtaatatgatctgtaaatatatataagtggcaggtgcatacagcacaagtactacaaaagagtttacaagtgtggggccctgctcagtccctccctttttgtagcgtctccctctgtacatggggactcccatgccatatgtgaccactgtctgtacctcatgcagggaacgtaaggctttcagggctcaatcccataaactaaatattggcaaagcttaatttct

SEQ ID NO: 33434 - DNA, 178 bp, Homo sapiens
tcatcctttattccacctccacagggatgaaaatggaagaatgatcatatatatgcacataccaatgtgaaagcatgttaatgagattaaggtaggacactatcagtcatagacatatttgtagtcataaacaaataagaatattaaaatataagccataagaaatcatatggattct

SEQ ID NO: 33435 - DNA, 503 bp, Homo sapiens
cctgacgtggtgagtgctccagtggcattaagaacatagggcatgtctgtctggtaacctatctccccagcagactgagctccacgagagcagagaccctggtgcagggcctggctcacagtgggtgctcaattaatattacttatgtgaaggaaccacttccagctgctcaagtattctatgctaaaacttgggtttctttcatccttgttgtcctcccaagatacaatgtgtacataattggaaagttagccaaggtgactatgaaggtgaccccacccaatcaatctatgtcttcctggttactgtgcctgtcattcgatgattccacggttatgtctatagtgataacagaaaaaagcaactgaaaacaatattatttactcgggtctcgtgcatctcctccacacatttgtagaaatgagattaccacaaattgccaagatggttacatcaaattttcagcagcatcagtcataggacaaaaaggcctttgagtgtat

SEQ ID NO: 33436 - DNA, 508 bp, Homo sapiens
atggacagctccaggacacagagctgcaggtggggacctccccctgctctggaaatcagccagggagcactgggcagtgcggtttgaggctctgtacccctggcccccacagctcagccacagcaccctctagcttgggggactagtccagggccaaaatgggataacccttccccatataagcagtaggatggcgtcccccctggtggagagaggaaggaggcctagagggtgtggggcagcttcgaagcgcggggagccgggggtctccaagcaccttctcctggacatgccagccttgaatgggggatgtgcagggcttcaaacccacctggcaggagccctgtggcagggcagagggaccctgctccaaattctctgttggctgcgcttttgtatccaatgcttttcagagtgtattcactcacccacagaaatagagccctgtgctttaggggtgactgtcatatgccttattcttaataaaatctctgaaaaacaaaaaaaa

SEQ ID NO: 33437 - DNA, 487 bp, Homo sapiens
ttaacttatctgagcctctattacttctaaaaagtgcataaagtgcagactaagacagtttttttggcaaaattcagtcagactacatcaagtaaactccctaagtctcctagtataattcatggcacaaaaaattggggaaaaaacagggaggatatgattataagttcagtttatgttttttgttgagtgaatgtctccagtcatagagatgcaagtgtagatacacagtaagagtagtatgaatgggagacaccttggaaggctatttcttccttccttcattcagttggtcactcagtgaactatcatgaattgagcaccgcctctgtttcttatcaacaaaggagactgcggaaaagaagagtgactaagatctctgaagaagggaaaagctagatgactgggccacaagaggaaaaaaagcagcaagacagttacaatggtttctggtcccacttttataaacacacacacacacacacac

SEQ ID NO: 33438 - DNA, 296 bp, Homo sapiens
aatccaagcaatgtgaacttctgcttctgtacaggatggagtaacagggactacatttatcattgtgactgaaacaactaagaaactggacaaaatatatggagcaatagttctcaagacactgggcatcaggcagcaaagaaaagttattgctgggagatggaaaagaaataaagtgagtcctgtgagtgcctcagtttactgtctatacaacagcgttgaggaatccaggcagagaccagagtctccttctgttgaagaggtggagctgggaattcaaagaatccaatgcagct

SEQ ID NO: 33439 - DNA, 448 bp, Homo sapiens
ttcagcactttaattctgcctctccggaaagacttccaaagaatggcagaatttgttaatgaagagttgagtatgaaactttctgtgactaactttccaagtttatattacctgtcttaggattgtgctgactgacaaactatgattatattgttggtaaccctatacaagtttctgaagagaaaagaaaaacggttgatgtttttgtgcataggtaatctgtgattgattcaactgttctttttttatgttgagggcatgtttttctttaaaatagcaaataattatgttaaaacttagtgtttgaatccctttcttaatgagatatggtggctataatttttaaataaggtagctaattatgagctatttgccaacctacaagtgttttcctcagtggtaaaacaatagaagcaacataaatacatccataaattagaatatcaac

SEQ ID NO: 33440 - DNA, 96 bp, Homo sapiens
gcccagcaatctgttttaacaagccctacaggtgattctgatcatgcttcataaagttagagatcatggccttccactgttcccttcttaggcatg

SEQ ID NO: 33441 - DNA, 466 bp, Homo sapiens
ccattacatttacaaaattttctagaaagttcaaactaatttttagtgttagaaagcagatcagtggctgcctgggaatggcacactagcgagaaggaagaataaggaacacaaacaaatgttttgaggtgcttgacagatgcactatgttggttgtacttgtgatttcaaaactgtacatgtatataaatttttcaaattgtacacttttaatatgtgcaatatcaattataccacaataaagctatttttaaaaagctgaaggtaagggttgaataatttccccaactttctcaccaatcttaaataaaagcaggtcacagagcaaatttgccacaggtggcaatattatcaagtaggtgcaaaaagagtcacatactctttctttgttgttttgtaagcttaatttagttccaacgttctatctttttatgtcttccaaccacactttacagagagactttat

SEQ ID NO: 33442 - DNA, 329 bp, Homo sapiens
gcaaaaccaactcttcatcctcttgctgctttgccagggattttaaaagcactgttctggtttttcttggctcacttggttttgtttcctgaacagcacttttgagctgtccaagatactttaatatgttatctttaaatgaaactaaatcctgctcattcgcgcgcccccgcgcgcacacatacacaggcgtacacaattaccttaacttcaaataaagtgttcttttctccatactcttctattcccttaacaatccctgttctcaaaggcctttgtgttttattttctgctttataacaaaacaaaaaaacaaacacccaccgtcc

SEQ ID NO: 33443 - DNA, 454 bp, Homo sapiens
  misc_feature (118)..(118): n is a, c, g, or t
tgtattttcagtagagacgtggtttcaccgtgttagccaggatggtctcgatctcctgacctcgtgatccgcccgcctcggcctcccaaagagctgggattacaggcgtgagccaccngcgcccggcctaaatttggtcatttttttgactgatgtgctacttcttactagattagggagatgcacttagcttttaaaacctgagttcctgttacatgatgaggctcttggacgtgtgtctctgactctgcgttgcgagcagagtgagggatgcaggatgatccctggtcctgtcctgtgctcctaccatcgagcccactacctggctggggagacttgtgaacgcatctcaccaaacccttcccaacagaccctcagcgagctctagcagctgccagctacctggcccagaaaagaaatacacccatcgtctcctactgatatcatttagaaa

SEQ ID NO: 33444 - DNA, 797 bp, Homo sapiens
aaaatatttaagggcctaccacatcagtgaagattttaaggctcagtgttgtaccttgaacaacctatcattaaaaaagaggtgcaaaactgtgcccaaaattcatgaccccagaagcttaaattttggaggcagcatttacttcacttgacaacgatatattcagttgctttataggctgactcacagataccagtttagagtggtatctagagcaaaaataaataataaataaatatgctctgcagcaagtttaaactttgatttaagctgtcctttattttggccatatcacctggcaggtcctatggaattacagaggtcatggtaggttaattatgctgagcatcgtctctagtaagtcccagggagagagatgctgggtagaccagtaggcttctgaaacaaagccatgccctctatagcagagaactttattatttatttatttatttatggctctttaaagatctagaagaccatcaactttatttgaatcatatgtcacacacacacacacacacacacacacacacacacacacccctacaaaacaatctgagaaatctgaacattgactggatatttgacagccttaggaatgattattaaagatgtgatcatagaattgtgattacatttttattcaacaggtttttggggaacaggtggtgtttggtgatgttaataagttatttattggtgatttctgagattttaatgcttccatcacccgagcagtgtacccgtacccaatgcatagtcttttatccctcaccccatttcccacactttct

SEQ ID NO: 33445 - DNA, 654 bp, Homo sapiens
ggaggcggatgttgcagcgagccgagattgtgccactgcactccagcttgggcaacagatcgagactctgtctcaaataaataaataaataatgagattatgcatttttgtagtgtaggtgtttcaggtatttgtttaagcaaagcatatgttaaggttaaaagcctttggaacactctgcccccacatcctggaagcgttttctttcctcccatccagttaggtaaagctacttgccatctcagtgtattcagtcagcttttaggaaatagattatttctgatgaatgaggatcctgctgcttcacaagtagatgttgacactcatggctccccaaagtctgcctcaaatctatttctgtgggccaggtatggtggctcacgcctgtaatcccagtactttgggagactgaggtgggcagatcacttgaacctaggagtttgagaccagcctgggcaatgtggagaaaccctatgtctacaaaaaataccatcaccaacaaaaaattagctgggcatggagacgtgtgcctgtagccccagctacttgggaggctgaggtgggaggatcacttgagactgggaggttgaggctgcagtgagccatgactgcaccagtgcactcaacctgggcaacagggcgagactctgactc

SEQ ID NO: 33446 - DNA, 1748 bp, Homo sapiens
ggaagggctggtggttcctgtaaaagtttgtgctccccgcgcctttccttccttccctcgtctttggcgcctgcgggcaccgggagtcctgggagagggaggaggaacggcgaatcggcggggcgtgtccttcacgccgccccgtagctcggggccgaagctggcgcagcgcgcgactttttgaaagccaggagggttcgaattgcaacggcagctgccgggcgtatgtgttggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaa

SEQ ID NO: 33447 - DNA, 474 bp, Homo sapiens
atgatccccctctgacatttagtattatgttcaactccaactataaatatcccggcctctccgtttatgcagaagcttggctttggtactggggtaaatgtgtacctaatgaaaaggtaagtataagatttcagattaaccttttttcatgcaactataattctactgtacttggagacaaagaagtagtctgaaaattccagtatttagattcggttgtctgctcctgatcctggctgatggctgtattccggtccctagacccttttgtaactttgcctgtagctctgcctctgcttctctcctagcttcctcctgatgggttattaaaggggaagtcatttactttttaatttttccttggcttccataagaaggggaagtggcaggggaaagggttcctttgtggtaattaaaccagattcttcatgagaaaacctcaaagaggaagccagttgattgggttgacgtcag

SEQ ID NO: 33448 - DNA, 231 bp, Homo sapiens
ggctccagagtctgtaatctcaacatccacattctatattcctactaatttgtaagagaattgctgtttctctacatacctgccaactgaccagcttcttgaatatttaccaacctgaaaggtagaaagtaatccttattgaggttgagtgtatttttacattttctggctacactgattaacctgtgaactacttgttcaaatcgttcgcctgtttccctttgggttgct

SEQ ID NO: 33449 - DNA, 2164 bp, Homo sapiens
ggaagggctggtggttcctgtaaaagtttgtgctccccgcgcctttccttccttccctcgtctttggcgcctgcgggcaccgggagtcctgggagagggaggaggaacggcgaatcggcggggcgtgtccttcacgccgccccgtagctcggggccgaagctggcgcagcgcgcgactttttgaaagccaggagggttcgaattgcaacggcagctgccgggcgtatgtgttggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaaaaaaaaaaaaaaaaaaaaaaaaaaaaaaaaaaaaaaaaaaaaaaaaaagggggggggggaaaaaaaatccccgggggggggcaaaaataggggaccaccattttgttgaaaagaggggggcccaaaataagaggagacccgaaatacatagcacagccgaccacggggccccagattaaacaaaaacgcgctgcggcttaggggaaaacagcgcctagtggtgagacagctctggggaaacgacaaccacaaccactggggggcgggaaccaagcgtggagaaccacctcactacgagaaattcaaggcccggaggagacaatatacagctggcggcggcaaccagggtgctaaccgctacgaaaagtcgcggcaaagaaaagtggccgcaccgacactgatcaggaaaagttat

SEQ ID NO: 33450 - DNA, 1969 bp, Homo sapiens
ggaagggctggtggttcctgtaaaagtttgtgctccccgcgcctttccttccttccctcgtctttggcgcctgcgggcaccgggagtcctgggagagggaggaggaacggcgaatcggcggggcgtgtccttcacgccgccccgtagctcggggccgaagctggcgcagcgcgcgactttttgaaagccaggagggttcgaattgcaacggcagctgccgggcgtatgtgttggtgctagaggcagctgcagggtctcgctgggggccgctcgggaccaattttgaagaggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatctttggtttttgctttaatttattaaatgtattttccatactgagtttaaaatttattaatttgtaccttaagcatttcccagctgtgtaaaaacaataaaactcaaataggatgataaagaataaaggacactttgggtaccagaaaaaatc

SEQ ID NO: 33451 - DNA, 1835 bp, Homo sapiens
gacccacgcgtcgcggacgcgtgggtcgacccacgcgtcgggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatctttggtttttgctttaatttattaaatgtattttccatactgagtttaaaatttattaatttgtaccttaagcatttcccagctgtgtaaaaacaataaaactcaaataggatgataaagaataaaggacactttgggtaccagaaaaaatc

SEQ ID NO: 33452 - DNA, 1912 bp, Homo sapiens
atctcttctttaaatttcctaatgtttttttcttcaggatcctataactcatctctgatacatataattaaatatttaataagttgtagtccaacatgctcaaatggaaaaattggaaagttacaattttcaggtttaaagttggtaacattccatctttacccttcaaattcttttcatcctctcccttccacagtatagatagtaagacttgtttcagtatattagatcttacctcccaattgaaatggaaatgtagcagaggtgttcatagtccaaactattttaaattctgtttttaaaagcaaatttctttcaagctttttcccaaaaatttggaagtcattttaaaaagtattgtggttttattgttttctatcctttttaaatgaatttttttcttagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatctttggtttttgctttaatttattaaatgtattttccatactgagtttaaaatttattaatttgtaccttaagcatttcccagctgtgtaaaaacaataaaactcaaataggatgataaagaataaaggacactttgggtaccagaaaaaatc

SEQ ID NO: 33453 - DNA, 1714 bp, Homo sapiens
ggaagggctggtggttcctgtaaaagtttgtgctccccgcgcctttccttccttccctcgtctttggcgcctgcgggcaccgggagtcctgggagagggaggaggaacggcgaatcggcggggcgtgtccttcacgccgccccgtagctcggggccgaagctggcgcagcgcgcgactttttgaaagccaggagggttcgaattgcaacggcagctgccgggcgtatgtgttggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatctttggtttttgctttaatttattaaatgtattttccatactgagtttaaaatttattaatttgtaccttaagcatttcccagctgtgtaaaaacaataaaactcaaataggatgataaagaataaaggacactttgggtaccagaaaaaatc

SEQ ID NO: 33454 - DNA, 703 bp, Homo sapiens
tgagtgtatttttacattttctggctacactgattaacctgtgaactacttgttcaaatcgttcgcctgtttccctttgggttgctgccttttcgtgatttgtagctcctgccttcataaccatcttgcttgtttcagtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaaggtatgaatacaatttctaacataaatcccaatctcttcatttcacactaaagattatataattttatctttctaagatatgtattagtactgatgactgatttggtaccaccaaggtttaatctcacacaaatgagacatagattgagaatagggagaaaaattgaggctatccagagaagcaaaacattatcttaaaaactcccctttcctgagaaaatgattgattggaaaactatcacaggaagggtaaaagtaggggtcgataacctataaatccaagactaaagcaaatctacttgatggcaggacaattgaagacatttccattctgtctgtggcagaatggaaagcatactggaccataaattcttgtttcaggagaaggg

SEQ ID NO: 33455 - DNA, 2027 bp, Homo sapiens
ggaagggctggtggttcctgtaaaagtttgtgctccccgcgcctttccttccttccctcgtctttggcgcctgcgggcaccgggagtcctgggagagggaggaggaacggcgaatcggcggggcgtgtccttcacgccgccccgtagctcggggccgaagctggcgcagcgcgcgactttttgaaagccaggagggttcgaattgcaacggcagctgccgggcgtatgtgttggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatctttggtttttgctttaatttattaaatgtattttccatactgagtttaaaatttattaatttgtaccttaagcatttcccagctgtgtaaaaacaataaaactcaaataggatgataaagaataaaggacactttgggtaccagaaaaaatc

SEQ ID NO: 33456 - DNA, 327 bp, Homo sapiens
ccacagagtccttgtgctcagtgtagtggctgagctggaggatgccctggaactcggagcacacagcactgacttgctatggtacctgtgcagtgaaattgaaggcagaatcaccaggatggaacacaggtcttgcaggatcacggaaaaccttcttggagttgtcttgacaccactgatgtcgagtgtctgggtgcttgtaggatgacctgccactcagtccaggggcaggagcaacggggagatcccacaagcaaagtgaactgggggatgggttgaaggggctccaggcaactgagccctactcgcaggtcctcagccttggcc

SEQ ID NO: 33457 - DNA, 883 bp, Homo sapiens
tctgagatggagtctcactctgtctccaggctagagtgcagtggcccagtcttggctcactgcaacctctgcctctcgggttcaagcgattctcttgcctcagcctcccgagtagctgggactacaggtgcgtgccaccatgcccagctaatttttgtatttttagtagagatgggttttcaccatgttggccagtatggtctcgagctcttgaccatgatccgcccacctcggcctcccacagtgctgggattacaggcgtgagccaccgtgcgctgagtgatacgtggttccctttaacttcgcacatggtaaaatcagtttctttccatgatctgtttcacagtctctgtgaagctacctaccacaaagaagtagtgagtgatgactttctagaatctaagtatatggcatgtatttattataagtaaaacattaagtttgctgattgtttacttgtgataaacaattattgtgaactttatttgtgctggacataagtgtctgttttacagtgaaattccattatagagggttacttggtagagaaatgcaaattgtagttggtcatatactaaaatttgaactttttacatatcaatacttacaaataggtgtttactttcccacaaaactccagaacatttaagagtctcgggtgtttaaatttgatgagatttacccaaacaaatagtgaacaaaaggtttatgaaaataagttatgaaactaaaatacttaataaacatccagtgacaataaaaaaacactagacatccagcagggggagccaggtggtacaggggcactcgaggctgcagtgggagcccatggggacactatacaagggcacaagttttccaactatgactactaacctgatcg

SEQ ID NO: 33458 - DNA, 430 bp, Homo sapiens
ttttttttttgaggtggagtctcagtctgtcacccaggctggagtgcactggtgctgtctgcgctcactgcaacctccacctcctaggatcaagcgattttcctgccttagcctcctgagtagctgaaattacaggtgcatgccaccacaaccagttaatttttgtatttttagcagaaacggggtttcaccgtaatagccaggttggtctcaaactcctgacctcgtgatctgcctgactcagcctctcaaagtgctggaattacatgcgtgatccaccgcgcccggcccagaaacttttattgacacagcaagtgacattccgtatctagatgagacagagtacgggtgatgtcttcagagatgacaacattcacagtgaaagatgagaaactaaaatctggctgggcacagcggcacatgcctgtta

SEQ ID NO: 33459 - DNA, 570 bp, Homo sapiens
gcccacctgcaacattgggggtcacatttcaacatgagatttggaggggacaaaacatccaaactgtatcagcttctttgtggtgacatttaaatctttctattatccccccattccctgtgaggggaatttggttttagacccttgactaagttcaggttcaacatttaggggaagaatccttcatatgtggtgctgtgtgcctaacctcaggaagaatacattcatttttccaccttcagagataatgagatggatcaaggggttccgtaaatctgtccattgtaagggcatcctccagccttctctcatgtaatggttccatccattacatatcacctgactcaactatttaggacttacaaaatgaggcaatcctaattttatcattcctaccctatgtagtatttggaaatctgtttaaaaaaaaaaaactcttccacataaaatagagctatttggtggaaatgcagtatgtataagaaagttagggtagccaggtgcggtggctcatgcctgtattcccagcacttcgggaggccaaggcgggtggatcacctgaggtcggga

SEQ ID NO: 33460 - DNA, 398 bp, Homo sapiens
tcgaactcctgacctaaggtgatcggccttcctcggcctcccaaagtgctggaattacaggcatgagccactgtgtctggcacaattaatattcttttgtagaaacttgtgtgaatggtttacataaacttgtgtgagaagagatgtatcttgtctcactaactcttatcttgttaagttttcccccagaaactgtgagtgtccaccctcttgaaggcgcagtggcggaatgaagttcacagaatggaagatgtgagctggtctgagtgatgcaaggggtggtcttgggtgggctcagttcctgctccctcagaggcctttggatctatttttgctgtttctgtgaactccgccagtgctttttggtgcttttgcttcaaacagccccatacccgtga

SEQ ID NO: 33461 - DNA, 696 bp, Homo sapiens
gccactgcccgaggtgagaagttctggtaggtcagggttagttgcttttcctttctcagtacaaataagtcagtcgggttacttcatgtagaacctcttctcctctcaacaaatgttgaaatgtttgtgtttttctccccatgatgaggaaagaagcctggagaggctagaggttgcagctgttcaagtaaagttttgtgattaaaaccccattgtaggtattccacaaatatttgaatcaaattgatttgttagctccagggtgtagggatagagtctgggctgagctgtttgatctgcacagtttttctgcttgaaacagatgctgtgcttgaaacttaagcattttctcgcctataatcttatatttatgctatttgcctggtccctgaaggcattttaaggacgtgacgctgtaccacctcagccctgggtgccgaattgatttgtttgtatgtgaccctggtaatagaaaagcttcatcagtgggtgccatctttggaatctatctatcttttgaaaacattgcacctttgagttcctgtggcactgttgtccatccacttctgtttttctgagtgtcctctgactttgccctttttatttgagattcctcctccattctcagctagatattcactccctcactggcttccctttctcttctatcctttttcatctcctttcctccctccc

SEQ ID NO: 33462 - DNA, 447 bp, Homo sapiens
agctcaaatggcctttgaaaagattgatgcaatatatcctcccgttttgagaattcaagtattatattcacttttcttgctcaacactggcccaaaccttgctttagctttttctccttcctattatagcagtggagaccgaccctgaatctgtagatagggagagcccagagcccatactctatttgggaagggaggctggaaactttcctgaatctgctttattcagcctttccatcagcctgacaccaagtcagttgctctgaaaaactgggtatgaagagggaacagatgaaagaggctaatgcccttctaagccactctctagcaccaccactactttcccaatgagcgcctacctttgcagccagaaaaattatgtatattgttgttaggaattgctgtttcaaactattattgcttaaatgcttattaaatgtatgttct

SEQ ID NO: 33463 - DNA, 343 bp, Homo sapiens
tccaaattgtattgttttcaacaagttctaaaatgtaattaggattatattgtgatggcatagtatattttccttccttaatcttgatcttattaagagccattaatagtttccacaaatccttgtttagctcctacagcaggccatatcatttgaggttgaggtgccactatactgccatgtttccagataataggaactcttgccgtacttcttatcatttctgctatctgatcgttctgttcagacaagctgaacatagtgtggccatggcacacagactgagaggtgcagtttatgctaaacatctccttaggggaccaatcaataatgattccatagg

SEQ ID NO: 33464 - DNA, 1000 bp, Homo sapiens
ttttttattttttattttttatgacacggagtctcactctgtcgcccaggctggaatgcagtggcacgatcttggctccctgaaacctccgcctccagggttcaagtgattctcccacttcggcctctcgagtagctgggactaccggcatgtgccaccacacccagctaatttttgtatttttagtagagatggggtttcaccatgttggccaggctggtcttgaactcctgacctcaagtgattcgcgtgctttggcctgccaaagtgctgggattacaggtgtcagccactgtgcccggcctcttttttgtgtttaaaatatgacttgaaaaatgtattaggctcatgggatgatcagagcacagaaaactgttcatttgggaagaaaatattctatatttggcatttaacccctcacctcagaattcccaccttagtattggcagcgttccctctacttttcagaacttttagtcctcagcctttggtgagccataaacttccccaattcctactttactctatgccctcatatatatatttagtttgttctatacgtttatacttactaagagtgctttgcaaattttctcaaattattttatggatagctctgtctttctgaactgtaagttaaactactcctaaaaatgagctgattttctacttctttcaaaactgctcttctcctcaattgtactagatgcagtactatgcatataaaatgatctcaataaaagcatgaaagcttatttcctgtctaaagaggcacataatccatttatctcaccatttgaggtagaaaaagaacggactataacagtccaaatttactactacatccttttcaaaaatctgatctcgattccgttttctatattcccatcattctcaattctgacttaagtgatggaagattaattccaaagacagtcaactagagctaagacaaagtagttaagtacaagaaaattaagtgctaatttattaagttatc

SEQ ID NO: 33465 - DNA, 483 bp, Homo sapiens
gcggccgctactactactagccgcctactactactaaattcgcggccgcgtcgacggagtgaacccagaaggctttgagccatcacaacactgcagcaggcgagtgtagcaggtggacacagagacggcccgaggcaccatggaggggttcactgccgcaagaggcattctgctttggtggcatgcccctcagagtgggtgtcaggggtctgtccggggctccagccctagctctgatgctgactttgggacattgggcaagttgccatagctctctggcgtcagtagtctcatccatgagttgataactctagatgtttactaaggtgacattaaattctaaaaatctatgtctgaaaatgatacttggataaaaatgacaagaaagcacataaagcattttagaaaaatgtctagctggccaagcgcggtggctcacgcctgtaatcccagcattttgggaggctgaggcgggcagatcac

SEQ ID NO: 33466 - DNA, 885 bp, Homo sapiens
ggggagtcagaattggggttggggtcccgtcgcaataggcctgggagatatttgggggctgtggataaacaaaacacatcctctggctcaggcagggtcccaggctgcaccaaggaacgagctgcctcaccatcagggtgcagagccatctgcaggtgatgggcagctgcgtttctaattcactcttaaactccaggtgaagccagggagagaaattccaaacatggcaaggcagggaaaggctgaaaatggggccagagttggtagggggaccatgtgtggaaagcatggtgcctgggagaggaagttgataggcaaagccccctgggagaatccactgacctctgggagccagccagttggtactgccctggtgggtgggacctcaggtgtgagagggaaagggccaggggacctgaggccttaccttgcagagaccgcgtattgtaagagattagaaatgcttgcaaaaatttaagctaatggaattagatatacttctactgcaaaaataaaaataaaaataaatgaaagtctttgtcataaggagagagagagagatctagtaagtgcagtaaaaaaagatgcatgggtcgtgtggtttggacatggacttaaacagaacagaggtgaccggggtggtgtgtgggtgagcatgaggcctgcacgcatgcagcagtgtgcttcaaagaaaggtcctggtgggagacaagaactgaacaaaagagacacgtacttgaaaatgtgcctccctggagacgtggcaaaggaatgggccttcatgggagcaggggagcggaaaccaccggatgctggatttccaccccaagggcaggcaaaagaaggctttggctggctcactgggcatgactccaataccagggt

SEQ ID NO: 33467 - DNA, 1564 bp, Homo sapiens
gtgccactacacttcagccttggcaatagagcgagaccctctctccaacaaaaaaagaaaaaattgttaatatttatttagtactcaattggtgccagacactttacatgcaccatctctttgatcctatgttataagcctataacacagaaaccatctacctcatttaaggaaacagagaggttaaataacttgtccaaaccatacagcaagttactggcaagactggcttgaacacaagtctgttgggctccaaagcccatgtccttaaacagtaccatgagagaactcttaatggacaagatatatccagtctactcatttaccccatgattctgtacagaaacttagcacagcacatttatatgagcattcaacatatgaagtagttaacagattaatatagttaccaaactaaaattggcctatgttaatttctattctcagttcttctgtgcccttcctcctcttaaaaaaaaaaaaaaaaagagagagagagagaaagggccaggtgtggtggctcacgcctgtaatcccagcactttgggaggccgaggcagctggatcacctgaggtcaggaattcgacaccagcccggccaacaaggctaaaccttgtctctactaaaaatacaaaaattagccaggtgtggtggcacatacctgtagtcccagctactgaggaggctgaggcaggagaatcgcttgaacccaggaggtgaaggttgcagtaagccgaggtcacaccactgcactccagcctggatgacagagcgagactctgtctcaaaaaaagaataaaaagaataaaaagaatgaaagaatgaaagaaagagagagaaagaaagcaagccagccagccagccagccagccaaggtggttcatgcctataatcccagccctttgggaggttgtggcaggaggatcacttaaatctgggagttcaaaacccacctggacaatatagcaagaccccaactcttgaaaaaaaattgctttaattagctagacgtggtggcatgaacctgtgttgggagactaaggtgggaagatcgctcgagcccaggagtttgaggctgcagtaagctataatcatgccactgcactctagcatggactacagagtaagactgtctaaaaaaagaaaaaaaagaaaaagaagctttttgcccactgttgcagttaactggcaaacttgtgtaataaattaactaacagaactggtttagcaacaaatgagatgcacaaggtctttaaattataaccctaggtatgttggtgatttgaaaggtgacctaacagcatttaaagtaagttatattttatatttatggggctttcaaaaccacagtcaaaaataagaacccaagcctgagtaacatggcaaaaccccatctgtacagaaaacacaaaaattagccaggcgtggtggtgcacacctgtagtcccagctgctaaggaagctgatgtgagaggattgtttcagctcaggaggcagaaggtacagtgagccgagatcatgccactgcactcgagcctggacagcagagtgagaccctgcctt

SEQ ID NO: 33468 - DNA, 320 bp, Homo sapiens
atgtttcaagttattaataaatgcaaaataaatattttgaatgtttgagttcacattcaaaaaagaaattcaataccttaatcttttaattctaaatctttccctaagatttcactgacaagttagttaagtcacatattttagacattagtacatatatatccatggtctttattgcattctataagatcggtttgttatacttagctaactttctgctgttagattcaaccttagatgggataaatgaggaacagccagcactttagcattgtataaaaccctacttcagaattgtagtgactcttccctcaagcact

SEQ ID NO: 33469 - DNA, 420 bp, Homo sapiens
gaaatatgtttttatacctctcagtttcagttagaggcatattttgtgtaatatttatggcttaaaatggactaaaggtcctgttcttgccttttctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcata

SEQ ID NO: 33470 - DNA, 427 bp, Homo sapiens
gatctaggttaccagagctagacaacatcttgacctataattctaacaggtacttatcagatacatgaaaacaaatgccaactgagtataggagatctcattttctacataaaggaaacatatatggctaaaaatgtcttttgatggtgtaaaaattttatgaatctgataaccacggggagggataatggaagtatgacttcaatctcccctcctccccttttacctttctttgcctatttctgagtatctctaggctaccaaatgtttcagtctgaatgtagaaaaaacaaaataatgagcaggaatagaccgactggcacaaaatgtaccaaatggaaacaatttccagacggaatgtacactgacatgcgcgacttactgtaaataattatacaaagcacaatacaatgagaacaagagcaaa

SEQ ID NO: 33471 - DNA, 299 bp, Homo sapiens
aaaattagaataattcatcttcatgaagagctacatgataaaccactgacttatttttatttgcttaacctgtttttttgcttcaggaacatctgtttttgtttttttggtctgttttaaagagacgggtcttgctatgttgtccaggatggtctcgaactcctggctcaagcagtccttcctcagcctcacaaagtgctgggattacaggcctgagccagccaggaacaacctattttgaaatgaaattattgtttacgattgcgccactgcagtccgcagtccgacctgggcgacag

SEQ ID NO: 33472 - DNA, 460 bp, Homo sapiens
ggcacaaggaagtgggttggattgactaggtttgggaattggttaagtgggtactaggtaaagcccagtgtgtgaagtagttaagggttctgctgaaagtgtagtttgaatgattggctgaggcattgaggataagagaagggagcagaggcttatggactagaccacttttttcagggctttaccttatcagccatgacaaagtatagagaatctggtctcaatgtaggtctctcactccagcagttttgcccacatttttcatggctgttagagaatcagggctgaaggcaagccttgagtgccacttacttggtaaaaaattgtgtcagattgctcactgtagccaagacagagttctttgtggcttctgtaacttgccatccaagtaaaaaaattttcttaaaagttgaaatgacctttgtataaaaagtaataaaatacttgctatgtgtcaggg

SEQ ID NO: 33473 - DNA, 332 bp, Homo sapiens
aagcgggaaatgcacatctagtgcagtagttttaggccagcctttttcagagcctcaggctctgcctgtcaccttgaagacatccatgtgggtcccctcagggcttctctttgccataaaaataaaatgattgctcccaccaatgtttgcgtccatgggagaggaggtaggagcagcagtacttgtcctgtgtgtgggagacacttgaagggctcagtgggaattgtcagcagcagggaacagaacaggtggtgagaagagtcattccactgagtttctgggcctttgactccctgaaacttccttctcctctatccaacctccctctccag

SEQ ID NO: 33474 - DNA, 300 bp, Homo sapiens
tatagattcaaagaaaccccaataaaaaatcccaacaaccagtttgttacaaatggactaaccaattattctggaaattcaaaggacctagaatagtcaaaacaacactaaaagcaaccataaatttggaggacatacattgcctgatttcttataataagaattatatatttatgtatttaatatataactacataaaatataaattttaaatttaatataaaagtatgataaaacgtaaatattttatattatgtaaatatgaaatgtttatatatgtaaatataattttaaaatata

SEQ ID NO: 33475 - DNA, 580 bp, Homo sapiens
agtggttctcaattttaggatgccaagactattggccaaacctcatctcttttcactttttcaggacattgtgtggctaagccagatttagtctctttactagagcaagagaaggagccctggatggtgaagcgagagctgacaggaagcctgttctcaggtgagtgcaggagagcctggtgtggaaaatctactgcaagagagagcggagcttttaccaaaaaggctgcatcctcactaatatacagtaggaaactttacccagggtctctgggtctggaaagaaaattgaactctgggagttccaaataattctttcctcctcctttgcccccttctctccagtaactgccatttccctgaagttccttcttttcttggccactgggacgtgtatcatccacttgcttccttaaatgatcttttctggaccctgatgcacttttgagctgacttccaaaggttttctcttctgtggttaaatggcctattgttttcatcatgcatccattcctgtgagaaccacaaattgaaagttatgggattgagccactctgctgagtattggcaggcgattgga

SEQ ID NO: 33476 - DNA, 4146 bp, Homo sapiens
  misc_feature (32)..(32): n is a, c, g, or t
ataaaaccaggccagagacagggaccggccantcgagcgcgctcgaaacgacgcgcgcggagggtgtggccaggggtgtgggtctgtgagggaccggtcggaagggcgtcgcgcggcctcgggtgacatgcggggggcggcgagcgcgagtgtccgcgagccgacgccgctcccgggtagaggcgccccccgcacaaagccccgggcgggccgaggcccgactgtagggactccagccaccttggccctccctgcccggggaaggccgcgctcaaggaatggcctcgcatccaaaggccagcgaggagcggcccctacggggcctgggcacagagctctgccttccagggacactgctcttccccaggagagaaacaagaagctggaggctgtggggacaggaattgaacctaaagccatgtcccagggcttggtgacatttggggatgtggctgtagatttctcccaagaggagtgggagtggctgaaccccattcagaggaacttgtacaggaaggtgatgttggagaactacaggaacctggcatcgctgggactttgtgtttctaagcccgatgtgatctcctcgttggaacaaggaaaagagccttggacagtgaagcgaaagatgacaagagcctggtgcccagacttgaaggctgtgtggaagatcaaggagttacctctcaagaaggacttctgcgaaggaaagctatcccaggcagtgataacagagagactcacaagctataatctggagtactctctgttaggggaacactgggattatgatgctctgtttgagacacagccgggcttggtgactatcaaaaacctggctgttgacttccgccagcagctacacccagctcagaagaatttctgtaagaatgggatatgggagaacaacagtgacctgggatcagcaggacattgtgtggctaagccagatttagtctctttactagagcaagagaaggagccctggatggtgaagcgagagctgacaggaagcctgttctcaggccagcgatctgtacatgagacccaggaattatttccaaagcaagattcatatgctgaaggggtaacagacagaacctcaaacactaaacttgattgttccagtttcagagaaaattgggattctgactatgtgtttggaaggaagcttgcagtaggtcaagagacacaattcaggcaagagccaattactcataacaaaaccctctctaaggaaagagaacgtacatataacaaatctggaagatggttctatttggacgattcagaagagaaagttcataatcgtgattcaattaaaaattttcaaaaaagttcagtggtaataaaacaaacaggcatctatgcaggaaaaaagcttttcaagtgtaatgaatgtaagaaaacttttacccagagctcatctcttactgttcatcagagaattcacactggagagaaaccttataaatgtaatgaatgtgggaaggcctttagtgacggctcatcctttgcccgacaccagagatgtcacactggcaagaagccctatgagtgcattgagtgtgggaaagctttcatacagaacacatcccttatccgtcactggagatactatcatactggggagaaaccctttgattgcatcgattgtgggaaagccttcagtgaccacatagggcttaatcaacacaggagaattcatactggagagaaaccttacaaatgtgatgtatgtcacaaatccttcaggtatggttcctcccttactgtacatcaaaggattcataccggagaaaaaccatatgaatgtgatgtttgcagaaaagccttcagccatcatgcatcactcactcaacatcaaagagtacattctggagaaaagccttttaagtgtaaagagtgcggaaaagcttttaggcagaatatacaccttgccagtcatttaaggattcatactggggagaagccttttgaatgtgcggagtgtggaaaatccttcagcatcagttctcagcttgccactcatcagagaatccatactggagagaagccctatgaatgtaaggtttgtagtaaagcgttcacccagaaggctcaccttgcacagcatcagaaaacccatacaggagagaaaccatatgagtgcaaggaatgcggtaaagccttcagccagaccacacacctcattcaacatcagagagttcacactggtgagaaaccctataaatgtatggaatgtgggaaggcctttggtgataactcatcctgtactcaacatcaaagactgcacactggccaaagaccttatgaatgtattgagtgtggaaaggcattcaagacaaaatcctcccttatttgtcatcgcagaagtcatactggagaaaaaccttatgaatgcagtgtgtgtggcaaagcctttagtcatcgtcaatcccttagtgtacatcagagaatccattctggaaagaaaccatatgaatgtaaggaatgtaggaaaaccttcatccaaattggacaccttaatcaacataagagagttcatactggagagagatcttataactataagaaaagcagaaaagtcttcaggcaaactgctcacttagctcatcatcagcgaattcatactggagagtcgtcaacatgcccctctttaccttccacgtcaaatcctgtggatctgtttcccaaatttctctggaatccatcctccctcccatcaccatagcctcgagacgtcatttctgtttgactactccagcagtttaaaaccccatctccctgcccttttgttttctttttgtcccttattagttagttcttcacataagtgtaaatgtaacttattcactcctcttgtaaaacttatagtttctttaaattggttaatgtgtgagatgtgctcagcacagtgcctggtccatagtaagtgctcagtaaacttagctgttttaaaaactttgtatttgaacattgaaaagttacagtagtcagctctgataaaaaaatgatgcagtagggtgagggtaggaaaaagcacattttctatcaggaacagaattctccagtagtgggtgaggttttgcctttgttggttttaaaacttgattctataatgccaagttagttttgtggctttccatctgaccctatgtgaatgtaaggtgatgtgaccttgttggtgagaaaattaaactttacatttgacttgatttgttttagaaagtctagggaccatgaatgaataggccagctgggacaaatgaatttaaaaaatcagaaaaatgcaagatttatatgcatgaagttaaaacaactgacgttactcaagaattagaaaactttgcaagatttgacttgtttaaaaatcacatttataagtgaaccgtattaaaacttttaaggaaccattcattgtgaggtaaactgatccagaataggggtcagcaaactatgactcatggccacagtctcactgactgtttttgtatggtccatgatctagaatttaaaaaaattttaaagggttgaaaaaagtgaaaagaatattttcaacatgaaaattatatgaaatttaagttttggtgtctgtaaataaagttttgttggcttcagccacacagtgatttacaccttgattgtgctgcttccaggctgtagcagcagagttgagcagttgtgacaggagaccatgtggcctgcagagcccaaatatctactgtctgatcctacacagaaaatgtgtgtgatccctgctatggagcagaggttatcaaactaaagcccatggaccaaatcctatctgctgcttgtttttgtaaatagagttttatcaaaccacagccatgcttacttgtttagctattgactatggctgctttagacaactgtgacagactatatggctcgcaaaactgcaaatatttcctatcctttaacagaaagtttgccaacctctgctctagagtagagaaaaatgtataaaagattttaattttatgagggcaatacaactgtcacatcagaaacaagaaaacaaatgataaaggaactcatttatcaatagaggtgaaaggaaattattaaactatattgaaaaataaagatgtcaataaaaggagaaatgatatttttctagat

SEQ ID NO: 33477 - DNA, 4086 bp, Homo sapiens
  misc_feature (32)..(32): n is a, c, g, or t
ataaaaccaggccagagacagggaccggccantcgagcgcgctcgaaacgacgcgcgcggagggtgtggccaggggtgtgggtctgtgagggaccggtcggaagggcgtcgcgcggcctcgggtgacatgcggggggcggcgagcgcgagtgtccgcgagccgacgccgctcccgggtagaggcgccccccgcacaaagccccgggcgggccgaggcccgactgtagggactccagccaccttggccctccctgcccggggaaggccgcgctcaaggaatggcctcgcatccaaaggccagcgaggagcggcccctacggggcctgggcacagagctctgccttccagggacactgctcttccccaggagagaaacaagaagctggaggctgtggggacaggaattgaacctaaagccatgtcccagggcttggtgacatttggggatgtggctgtagatttctcccaagaggagtgggagtggctgaaccccattcagaggaacttgtacaggaaggtgatgttggagaactacaggaacctggcatcgctgggactttgtgtttctaagcccgatgtgatctcctcgttggaacaaggaaaagagccttggacagtgaagcgaaagatgacaagagcctggtgcccagacttgaaggctgtgtggaagatcaaggagttacctctcaagaaggacttctgcgaaggaaagctatcccaggcagtgataacagagagactcacaagctataatctggagtactctctgttaggggaacactgggattatgatgctctgtttgagacacagccgggcttggtgactatcaaaaacctggctgttgacttccgccagcagctacacccagctcagaagaatttctgtaagaatgggatatgggagaacaacagtgacctgggatcagcaggacattgtgtggctaagccagatttagtctctttactagagcaagagaaggagccctggatggtgaagcgagagctgacaggaagcctgttctcaggccagcgatctgtacatgagacccaggaattatttccaaagcaagattcatatgctgaaggggtaacagacagaacctcaaacactaaacttgattgttccagtttcagagaaaattgggattctgactatgtgtttggaaggaagcttgcagtaggtcaagagacacaattcaggcaagagccaattactcataacaaaaccctctctaaggaaagagaacgtacatataacaaatctggaagatggttctatttggacgattcagaagagaaagttcataatcgtgattcaattaaaaattttcaaaaaagttcagtggtaataaaacaaacaggcatctatgcaggaaaaaagcttttcaagtgtaatgaatgtaagaaaacttttacccagagctcatctcttactgttcatcagagaattcacactggagagaaaccttataaatgtaatgaatgtgggaaggcctttagtgacggctcatcctttgcccgacaccagagatgtcacactggcaagaagccctatgagtgcattgagtgtgggaaagctttcatacagaacacatcccttatccgtcactggagatactatcatactggggagaaaccctttgattgcatcgattgtgggaaagccttcagtgaccacatagggcttaatcaacacaggagaattcatactggagagaaaccttacaaatgtgatgtatgtcacaaatccttcaggtatggttcctcccttactgtacatcaaaggattcataccggagaaaaaccatatgaatgtgatgtttgcagaaaagccttcagccatcatgcatcactcactcaacatcaaagagtacattctggagaaaagccttttaagtgtaaagagtgcggaaaagcttttaggcagaatatacaccttgccagtcatttaaggattcatactggggagaagccttttgaatgtgcggagtgtggaaaatccttcagcatcagttctcagcttgccactcatcagagaatccatactggagagaagccctatgaatgtaaggtttgtagtaaagcgttcacccagaaggctcaccttgcacagcatcagaaaacccatacaggagagaaaccatatgagtgcaaggaatgcggtaaagccttcagccagaccacacacctcattcaacatcagagagttcacactggtgagaaaccctataaatgtatggaatgtgggaaggcctttggtgataactcatcctgtactcaacatcaaagactgcacactggccaaagaccttatgaatgtattgagtgtggaaaggcattcaagacaaaatcctcccttatttgtcatcgcagaagtcatactggagaaaaaccttatgaatgcagtgtgtgtggcaaagctgaatgtaaggaatgtaggaaaaccttcatccaaattggacaccttaatcaacataagagagttcatactggagagagatcttataactataagaaaagcagaaaagtcttcaggcaaactgctcacttagctcatcatcagcgaattcatactggagagtcgtcaacatgcccctctttaccttccacgtcaaatcctgtggatctgtttcccaaatttctctggaatccatcctccctcccatcaccatagcctcgagacgtcatttctgtttgactactccagcagtttaaaaccccatctccctgcccttttgttttctttttgtcccttattagttagttcttcacataagtgtaaatgtaacttattcactcctcttgtaaaacttatagtttctttaaattggttaatgtgtgagatgtgctcagcacagtgcctggtccatagtaagtgctcagtaaacttagctgttttaaaaactttgtatttgaacattgaaaagttacagtagtcagctctgataaaaaaatgatgcagtagggtgagggtaggaaaaagcacattttctatcaggaacagaattctccagtagtgggtgaggttttgcctttgttggttttaaaacttgattctataatgccaagttagttttgtggctttccatctgaccctatgtgaatgtaaggtgatgtgaccttgttggtgagaaaattaaactttacatttgacttgatttgttttagaaagtctagggaccatgaatgaataggccagctgggacaaatgaatttaaaaaatcagaaaaatgcaagatttatatgcatgaagttaaaacaactgacgttactcaagaattagaaaactttgcaagatttgacttgtttaaaaatcacatttataagtgaaccgtattaaaacttttaaggaaccattcattgtgaggtaaactgatccagaataggggtcagcaaactatgactcatggccacagtctcactgactgtttttgtatggtccatgatctagaatttaaaaaaattttaaagggttgaaaaaagtgaaaagaatattttcaacatgaaaattatatgaaatttaagttttggtgtctgtaaataaagttttgttggcttcagccacacagtgatttacaccttgattgtgctgcttccaggctgtagcagcagagttgagcagttgtgacaggagaccatgtggcctgcagagcccaaatatctactgtctgatcctacacagaaaatgtgtgtgatccctgctatggagcagaggttatcaaactaaagcccatggaccaaatcctatctgctgcttgtttttgtaaatagagttttatcaaaccacagccatgcttacttgtttagctattgactatggctgctttagacaactgtgacagactatatggctcgcaaaactgcaaatatttcctatcctttaacagaaagtttgccaacctctgctctagagtagagaaaaatgtataaaagattttaattttatgagggcaatacaactgtcacatcagaaacaagaaaacaaatgataaaggaactcatttatcaatagaggtgaaaggaaattattaaactatattgaaaaataaagatgtcaataaaaggagaaatgatatttttctagat

SEQ ID NO: 33478 - DNA, 1445 bp, Homo sapiens
  misc_feature (32)..(32): n is a, c, g, or t
ataaaaccaggccagagacagggaccggccantcgagcgcgctcgaaacgacgcgcgcggagggtgtggccaggggtgtgggtctgtgagggaccggtcggaagggcgtcgcgcggcctcgggtgacatgcggggggcggcgagcgcgagtgtccgcgagccgacgccgctcccgggtagaggcgccccccgcacaaagccccgggcgggccgaggcccgactgtagggactccagccaccttggccctccctgcccggggaaggccgcgctcaaggaatggcctcgcatccaaaggccagcgaggagcggcccctacggggcctgggcacagagctctgccttccagggacactgctcttccccaggagagaaacaagaagctggaggctgtggggacaggaattgaacctaaagccatgtcccagggcttggtgacatttggggatgtggctgtagatttctcccaagaggagtgggagtggctgaaccccattcagaggaacttgtacaggaaggtgatgttggagaactacaggaacctggcatcgctgggactttgtgtttctaagcccgatgtgatctcctcgttggaacaaggaaaagagccttggacagtgaagcgaaagatgacaagagcctggtgcccagacttgaaggctgtgtggaagatcaaggagttacctctcaagaaggacttctgcgaaggaaagctatcccaggcagtgataacagagagactcacaagctataatctggagtactctctgttaggggaacactgggattatgatgctctgtttgagacacagccgggcttggtgactatcaaaaacctggctgttgacttccgccagcagctacacccagctcagaagaatttctgtaagaatgggatatgggagaacaacagtgacctgggatcagcaggacattgtgtggctaagccagatttagtctctttactagagcaagagaaggagccctggatggtgaagcgagagctgacaggaagcctgttctcaggtgagtgcaggagagcctggtgtggaaaatctactgcaagagagagcggagcttttaccaaaaaggctgcatcctcactaatatacagtaggaaactttacccagggtctctgggtctggaaagaaaattgaactctgggagttccaaataattctttcctcctcctttgcccccttctctccagtaactgccatttccctgaagttccttcttttcttggccactgggacgtgtatcatccacttgcttccttaaatgatcttttctggaccctgatgcacttttgagctgacttccaaaggttttctcttctgtggttaaatggcctattgttttcatcatgcatccattcctgtgagaaccacaaattgaaagttatgggattgagccactctgctgagtattggcaggcgattgga

SEQ ID NO: 33479 - DNA, 715 bp, Homo sapiens
  misc_feature (32)..(32): n is a, c, g, or t
ataaaaccaggccagagacagggaccggccantcgagcgcgctcgaaacgacgcgcgcggagggtgtggccaggggtgtgggtctgtgagggaccggtcggaagggcgtcgcgcggcctcgggtgacatgcggggggcggcgagcgcgagtgtccgcgagccgacgccgctcccgggtagaggcgccccccgcacaaagccccgggcgggccgaggcccgactgtagggactccagccaccttggccctccctgcccggggaaggccgcgctcaaggaatggcctcgcatccaaaggccagcgaggagcggcccctacggggcctgggcacagagctctgccttccagggacactgctcttccccaggagagaaacaagaagctggaggctgtggggacaggaattgaacctaaagccatgtcccagaaaaactttgctgacacctgaagtggaggttaagagcatggactgtggagtcagactcctgggttcaaaacccagctctacagctgactgtctgtgatcctgggcacattacagctcaatattttctcatctgtaaaatgggaatagtaatagtactgactattaggatcgttgtgaggattaaataagctaatatataagtatatagaattgcgtctgaagtgttgtaagtgctttcagctattgttattgctgttatttacagtaaaagacatttttaaaacaaaa

SEQ ID NO: 33480 - DNA, 521 bp, Homo sapiens
ttttttttttttgagagggtctttctctgcccaggctggagtgcagtggtatgatgactgctcactgcagcctcaacctcccgggctcaagtgatcctcttgcctcagcctcccaggtagctgggaccacaggcatatgccacaatgcctgactagtttttatttatttttatttttttatagagacagagtctcaccatgttgctaaggctggttttgaactcctgggctcaggcaatcctcctgcctcagcctcccaaagtgctgagattacaggcataagccaccgcgcccagcctgaaatgttcattttaagtgtttattgtcctgtatgttttgaaatttttactgactatatgtaacaaatttgtcactccatctaggcacaagtgttttaggtgagcataaatttttttttttgagacagagtctcgctttgtcaccaggctggagtgcaatggtgcgatcttggctcactgtaacctctgcctcccagattcaagcaattctcttgccttagc

SEQ ID NO: 33481 - DNA, 1238 bp, Homo sapiens
gggagatgtgctcagaggctggtgagcgtttaattgacctggttgtgagcacaatgggaatgcttttctgaaccttccatttgcctccaatttagaataactgcttagtcagcaacatgtctccaattaacatgacagattttttggaccacagatctctttgggaatcttatgtaagctgtgaaacttctcccttaaaaaacctacatatttaattctgtctgtaattttaggacttcacatatccccaaagaccattcatgatccaccagggttaaagacttgttttaagtaaagaaaatattcgcagcctctggagtagtagacatctccagagaaagtctggcattctttggtaactcatggcatttattacattagctttggatggaacaacccccaacccccaagtctgagcatgtggtttgatgctgcttcctttccattttcactctgctctcttggattctatgtagcaaaaaggtaccttttctagggtcacatgtccacttctcaaactctgtcttgcactggggatttgagggtggactatcagagcataatggaagaggcaggaaaggatagcactaattagagaacttgataggccttttgctactgataaagattctgtcctgtatcatccatgaggtttggatttgcacttctaaaaaatagctgtgtgtttttgacaatagccactccctttttgctcctttctggtctctttcctaaatgactttccaggatagtataaaataagcaatctatttagaggaacaaaacaaagaactacaccattagcattaaaatatttctagggtagtttaggtaacatagaactttgtagctcagcagtcttggaatcactagactctaagccccatgtagtcagagactgcctgcttttataattcatccccaacagcaggctattgcataacacattgttaccacccacaccattttgttgagtaaatgaatgaatgcatgaacgaatcagaggattctattgtctaaataaactttggaggtgacttagtcttctcttccctctgatgcttagatcttctttatctctcagttcaacatatattgctcaaatggttcctaggtgcaagggatctggaagttattaaaatgaaatagattttggaccatgaccttgacaaattatgatctactaggagagataatatggaaatcagtataatactacagagacagtaaaaaggaaa

SEQ ID NO: 33482 - DNA, 1818 bp, Homo sapiens
tccctaatggatggtacaggtcaacatttgccatctaatgacacttacattccagttttttccttttttgagtaactgggaaaagggtggcattactgctggcttcctaaaattgaaaagtatactagggtttttaaacctgtgtagaatacatgatatggtagcaaatgtgctgtaggaagaaaagcaatgaggaactactggcctgactaggaggcctagaagtccctcccaggcttgagttgttctgacttggcatgattacatagctgcggcaagtgacgtttccttcaagccttggttccctcatctgtaaaatagggaactaatacctacctcacaggattgtagttagaattaaggatgacttcattaaagcacctctagtggtggaagatgtcccatcctatcccccacccatagctgggagctatgtttggctcattcttcctgactcactggattacactgtgactcagttcaatttcacacatgctgctgctaaattagggtcttggtgagcctttgggaggacagctctgaggaatgaattgtagcactgcagccctgcctgaggaacatgatagaaacaggtggtaggcccagctcttgccttccacctactaagcagtttttctgtggttagctgtgtgacataaactatcggtgtattaatttgctttcactagattcccccccccccaacaacttagtccaagaacatacctgaattctttgcatttccttgccttagttgcttttgtagggtggacagcaggactgcatgagaatagctgtgcttctggaccctatggtgaaagctctagtgaactgcaattaggcccagggtcccggaggaagaaggggagagaaaaaggggggtagttttccaaaagataagtaggggacaaaaaagtccacggggcctatgagcggtgagactcctgccctgattgtggcaaagcacctggagatgatagaacttcctagggaaaaggctgcatggagtccccagggatgctgggccctggtcaccaaggctccctgggaaggtctcttgtacctggggcacacagaccaacacttctgaatttgcaagcttaagagcatgtatgagcagaacctgtgcagaccaaggcttagagggctcacctcaatgttttgcactgtgtgagaccccaggaccttttcgtgattctggagaggggaacaaaccataataacaacaaaccaggtagcaggatagagactcattctcatctattttggttaaaagaaaataaatgtatttcttccacacctgattttgtgattgcaaattcataactaatatccctcgtcagctccgctgactcatccctgccacagggaggttcacagcaagagcacagaaactagggccagtgcccggttgtgtgaccttgagtaagttctttttcccttgaacagggagagagacacaatggatcagagtgtctctgccagttctaacttggggattctagtgggttgaaccgaacggtagtccgtttccaaaagaggaagccaagaccagagggggagtggttccttcaagtttgcagaaccagtaagtggcagagcaggactcatatctagttagtggttcagagcatgggctccggagctagactgcctggatttgaaccctggctttgccacttgcctgttgggtgactttggacaagctgcttaaattatgtctccatttcctaatccacagaacaagtgtaatactagttatctgtttcatggagtgattgtgaggattaaataaagttaatataacacaaaaaaaaa

SEQ ID NO: 33483 - DNA, 440 bp, Homo sapiens
tgttctcccacggctctgccctcttcaggcacagtcactgcgtatgtgcatcctgctcttcacacctcattcacttcacaagctgagcaagctgtcccgtctgcactggggatggagctgggcactggagacacctccaagaaaaagcagatgagctccttgccttgtagtggaggcactttactaagaaataaatgaaatgacaaattgtaccagggctctgatgaaaatggggtgccctgacagagagtaaggggatggggggttcccaatttcaggacagtggtcagagaaggcccctttcgagagaaaccattgcattttagacctgcaggttgaaaacagtcagccccgccacttcgggggctagaagtaggaagtgacagtgacagcgtgtgcaaaggcactggggcgggaaggaggttggtgggtgagaagca

SEQ ID NO: 33484 - DNA, 383 bp, Homo sapiens
gtcgcccccagaggccggacgctgcggctcggccgacccccgcgcggtggcagccggagcgctagggaaacgagtggagccccggcccggatcctgctgcgggatccagaaggcccgagcacttcgcgtccccctgcccagcagttgagcagacgcccctggggcggaccccacccttcccaaacacacacacactggtctttgcatgggcaggacacagttaaacacccaccaggcctcccggttattgggttagagtatggaccgagcaggagtttactgccccattcaccaccgcccccaaccccacctaccccaaatagggatgcggagactatccctcctcccaccaagacttgaacagagcctctctttcaagccca

SEQ ID NO: 33485 - DNA, 490 bp, Homo sapiens
aaattcacgaaaggatttttttttctcatctcctttctccatttatttactccaactgcttttttagctaaagacaaaagatgctgtagtcatgggtggcagaaccatgcttttgtgtaggcagtgctcccaaagtttgtttacagtgcttttgcttgcacctcagatcatttttccagaatgttacggattttttttttcttcttcttctttttttttttcttttagaacactgttcacgatcactttttcatataccatgggactcaggcaaacccttttttaaattcctggttatatatttgttttaatgttcattagtatttgtttgtttgtttgtttgttttctttaacagccatcaaggctaggcatggtggctcacacttgtaatctcagcaatttgggaggctgagacaggaggatcacttgagtgcaggagttcaagagtagcctgggtaacagtgagataccatctctgggaaaaaaaaa

SEQ ID NO: 33486 - DNA, 697 bp, Homo sapiens
agatcgagcgaggagaggggctgctgcagggagaatgcctgacagtggattccttttcagcgaatacagctgggatggggtcatgtacgcacagatgtgttttcttccagggcaagggatgaattagcaccacagatgagtgtgcagtgggaaaaaggaaggagttgtctcattgcaccctatgagtactgcctgcctcatgtgccagttaaagacctcaaacaccagcaggagtctcccttggggtctgatggtaggaatgcatttacaaatcaagacccttcaggaagcccagacatgtttcgttccattcctttgctgcaccaaggacctgatcgtattgtctggcaagcacagtaaatgctgtagaaaaacaagtgggcattgtttcataatgggcccttctgccttctatgaggctagttgatacttctttgcctttgtctccctataaggcagaaaacacatctgtgcgtacatgaccccatcccagctgtattcgctgaaaaggaatccactgtcaggcattctccctgcagcagcccctctcctctcctgctcttgccatcctctgcttaagtagtggggcacccgggagtcctgtttacagctaattagattaggagtgtattcatctggaaagatatttgtagttcaataaagagagtatgaagactctctctcatggttccagaga

SEQ ID NO: 33487 - DNA, 332 bp, Homo sapiens
gagaatatattcttctttcatctgcctttttgttctttctgtgccctcagctgattggatgatgcccacccacattgagagcaggtattcctcactcagtccactgactcaaatgcctgtctctcctggaaacatccccacagacatgcccagaaataatgctttaccacatgtctatgtattcctcaatccagtcaaattgacacaaagttaactatcatggctgggcacagtgactcacccctgtaatcccagcactttgggaggctgaggtgggtggatcgctggagctcaagagcttgagaccagcctggcaacatggcgaaacaccg

SEQ ID NO: 33488 - DNA, 615 bp, Homo sapiens
catgctcaaggcagcactgacatgccagccttccaccttcttggcccactctgaactttgggcactgatgagcataagagggaagctgatggggggctgagggcagcttgcactgacctgcaggtgttccttgatatatacatcctgggtgccatgaaaggcagcaggaggcagacatgttcctgagtgcaagggggtgggcccctggtgaggccccaccttcaggccagggaggacctgaagggtgggaactggcctgccagtcctgcaaaccccaatgtgaacttgtggtgccttttccaggcctccccatggccacccatggaccagtcggcattcacttcctcccttctgcggcccataaaagccctgggttcaggcagagctgagcagacatcaggtgaccagctgcagaaaggagctacccactccagggcctcatctctgctgagagctgcagagatgaccagaagacctgcatccagagaggagcttcctgatccagggctattctgtcactcaataaagcttctctttgtcttgttctcgaaaaggcaaaacgaggaggcccggaggaacgggggggcgggccgagaattttcgccccgggggcca

SEQ ID NO: 33489 - DNA, 506 bp, Homo sapiens
actgttaatatattccaggtctagcatttctcattccttattagggaagagctaagagatcatgagaggaagagttgaaatgttggtaagttacaggtacttttgcatgtgcttttgtatatgcatagaaaaaaaagaacctcagacagttattacctcttggtttaaatttgggaaaaacgtggacttttgccctttacactgtgtagttatgtatattttgcattcttttccttatagcaggccttaacttttgaaataaaagaacatacaattgtaaagcattccatctttttttttttttaatcaagccataaagccagataaaaatataagagcatttatcacatttctagatggtggaagatatccaaagtttaataggtatataagaaattagaaagacagattttactgtgtgaaaagtttaaatttttgaatattaacagaaaaaaagaaaaacattaacagcaaataacttgggaaaaatatttgtggtaaatagg

SEQ ID NO: 33490 - DNA, 498 bp, Homo sapiens
tttttttaaaattcaggattttctacattgttgtggggaaggagagtaatgatcaagagataatagctattcaaaaaattattaatgggctatttgaagaaggtgttaaaagagatcccaagaagggaaagcatggtataatttcatgatactttaggacaatacaattatttcccaggttttagtagagtaggtgtaagtatattcgtatataacatacacttggctgtattgtgccataaagaatgaataagtcaagcaaccatatcataaatggcttgttaaaagttaaaacactgctatttatacgtaaaatttaactgctattttgatagatcatgtgtaggataactttaaaaaagtaaaactatgggggaaagggcaggtattattttcctaatggaatccaaataattccactagcctgaatttagagtttgacttcaagttcataatatttttaaattaaaaaaatgtgtgtgtgtatatatgttattc

SEQ ID NO: 33491 - DNA, 398 bp, Homo sapiens
gaatggcctgtgcaaaggtccagagaccagagcagacagcggcatcagggcgtctgcaggggacttgggcaatgcaggtgggctggtggcgagggacatctgtgtcgtgagtggggcttagacgtcctcttcacccagacgtggagtctctaacgcttggaattttttttagcagcagaacccattttttttcttttttttgaaacagaatcttgcgctgtcacccaggctggagtgcagtggctcaatctcagctcactgcaacctcagcctcccggcttcaaacaattctcctgcctcagcctcctgagcagctgggactacaggcatgggccaccacgcccagctaattagcagaacccattttttaaaatgaaatccctgcagccttgacatgt

SEQ ID NO: 33492 - DNA, 528 bp, Homo sapiens
ggctgtctgttacagattttatattctatatggtggtgttatttatttctgtcttatctccattctggattttaagttccttgacagctacaagaatggctttacatttttgtagcctccacaggccttgagcacagtgacattcacataatatgcattccaaaatcatctgctgaatcaaacaagggagataagacaagcttgtaacttaagcacaaaccatagtaacaaacataaacatgctggttacattatgaatataatgctgagtatatccataaatgcttaagtcgcaggagaaatacaaatgctttaaccttggagtgtcaggaacaattacatgaccagggacctactaaggtagggtaattttggtacagtacatggaggagattcagccttgaagagagaaaaagcttattttaaaatggaaaaaacaaaaacagaaaccccacagataggacttggtgtagaaagaggaggtgtttgtacagaccattgattctcaacccaggtttatgttggaat

SEQ ID NO: 33493 - DNA, 172 bp, Homo sapiens
attattaagaacctcatctgtgcctcgtcaccggcaatatggccttgaagagagaaaaagcttattttaaaatggaaaaaacaaaaacagaaaccccacagataggacttggtgtagaaagaggaggtgtttgtacagaccattgattctcaacccaggtttatgttggaat

SEQ ID NO: 33494 - DNA, 259 bp, Homo sapiens
gtaattcagctatctgggaggctgaggcaggagaatctcctgaacccgggagacggaggttgcagtcagccgagatcgcgccattacacttcagcctgggcaacaagagcaaaactctgtctcaaaaacagacaaacaaaaagccccgaaactctgtacctgtgaaatgctaactgcatttctgtcctcccctggcccctggcaatcaccacctattttctttttttttttttgagacagtctcactctgttgcccagg

SEQ ID NO: 33495 - DNA, 953 bp, Homo sapiens
ttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagatttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgctttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgat

SEQ ID NO: 33496 - DNA, 457 bp, Homo sapiens
tagctggtaaatgaactacatattttaatcatacataatatttatcaatcgcttaacacaatgcctcatgttaagcagctactgtagacaagtgctgattattgttattagctatatatatatgttttatatgttattagccatatatatgttttatatgttatcagctatatatatatatatgttttacatttccttattcatgttctttctaaaccagatagatgtcccatgctggggctccatgatgcactaatctggctgtactcacattgggttgatcgttcttgaggttgtacatcagttcagatgacctgaatattaacgtgtgcaccacttctcaacctggagccttctggcatatccccagagcccattaaatctataaaaatctaaaatgtgttttcctatttataatactattaaagtaataaaaatactttctagaatccctgca

SEQ ID NO: 33497 - DNA, 449 bp, Homo sapiens
  misc_feature (20)..(20): n is a, c, g, or t
gaaaatgctacagaaccacnttaaaaacaaagaaatatagctagtaagtccaaaatgggaaacaaaatcaaatcactgtgcccagccatttgtttattttcttaggaaaaatgtctattcaaattatttgctgcctttggttcttcctttatcttattacgtgccagaaaccctccttgccccttgactttttcattcttccctcttcggaggtataatataaccattgtacagtggtttagagtttaggctactgtgatgtggcacctatttctacctcttattgtaccaactattgtatcttgggctagttacttaatcctgcagagcctcagttttcttgtctgtaaaacaaagatatcagtacttccctcacaactttgttgttttgaatgagatgttgtatgtaacatggttagaataggacctgacacccaccaggtattcca

SEQ ID NO: 33498 - DNA, 364 bp, Homo sapiens
tttttagcaaattgaagaaataaatgcaaaccatggagtcccactaatacattagatacttaatgcaaaggtgtcagagataatcttttgaaaaaattaacctaaaataaaggcactcagaaacagttgttttcccctcctttggaaaaaattcttccaagtgaaaatgtttgattcagactcaaatataaatatagaggttctgtggtttttacttgattcctgttaaaaaaaaaaaaaaagaaaaaagaaagaaaaaaaaaacctcttctttcctggaatgtgagtcacaaaagatattgtagacaaatttaatcacaatcacacatggcagttttctgtacattacattttagactaagca

SEQ ID NO: 33499 - DNA, 308 bp, Homo sapiens
tgtagagatgggttttctccttgttgcctaggccagttttaaactcttgggctcaagggatccacccattttggccccagcactttgggaggctgaggcgggcagatcacaaggtcaggagtttgagaccagcctggacaatatggtgaaacccagtctctactaaaaatacaaaaaaaattagctgggcgtggtggtgtgtgcctgtagtcccagctactcaggaggctgaggcaggagaatcgcttgaacccgggaggcggaagttacagtgagtcgagatcgcgccactgctctccagcctgggc

SEQ ID NO: 33500 - DNA, 305 bp, Homo sapiens
catgaatgactccaccaagtgtgtccgaatctactgcttagttctgatgatggcagaaataaatcaatgtgggtgtgtgtaataataatgtatattgttatttgcatgggttaccaatattaaaataatatttagagtgaagaccatgatatttgacaccttggtactcctgtccacatagaaaaattatttttaaagtggagagatagaaataaatcatttcccctcagtgaaaattgatttgttaattaaaaataattttgattagcttgtattcaattatttacaatgaagaataccaaata

SEQ ID NO: 33501 - DNA, 365 bp, Homo sapiens
gccttgattggcacaactgtggaggtcatcccagctctggagccccaacaggatcactcaggcctctgcttccaccacatctggcttcagcttccccctctgtggagtcctccctccctccctccttccccataggaaatgaccccagtgctcagcagtaacccccactgcgcgcagatctcagaacctccacctcaatctacagccacgtgccacaataagaagcagagttttaggccaggcgcggtggctcacgcctgtaatctcagtactttggaagaccaaggtgggaggatcacttgaagtcaggagttcgagaccagcctgcccaacatggtgaagccccgtctctaataaaaagaata

SEQ ID NO: 33502 - DNA, 383 bp, Homo sapiens
tatatataggtctaatgccctaaaatgattatggccttaatagtaaattgcaaaaatgtatgttgtactcatcttcattctgttacaagtgtaaaatgttgggatagaggtttgattattgctctactgaatgcttgactaaagtaattatatgacagcttttccttagaagtacttgcgttagcatccaaataaagtaatgatgaaatgaatactgccaaaataaagtatgaattgcatttaatgggtttacagaattttggaccattgcaaactttagtcatctggtgtcggatgtagtagtatagaatattaataaaagattttcttctatggaataccagtattatggaaaagcgaaattaaagtatatcactggacta

SEQ ID NO: 33503 - DNA, 718 bp, Homo sapiens
gcatgagccaccgcgcctggccattctttcatttgaggggaattgtcttactgatgttaaaactgggtctagagatgtggctctcacagtggagtgagtcccaaagccaggacaagaacttcaggtccccacctcctagcccaggacccaggcttcagatcaactttccgcaggggaaagaaataatggtagcaacaacagcttgctcagctcctttctatctatcgttttgatctttactgccttggccccaccctggtgctgcctattcacgcaggtgcgtgctacagatgcctcaggggcttctactcctgcctgatataaaagcaaagaggctgaattttaaatcaggtgtgagatctatgcttaaactcatctctgctgtttgcctgctgtgggaccctagatctctttttttctgaatttcagttatctcatctatagagtgggatgagggtaagaatacctcacagcactgttgcaaggatcagatgtgccttagttactataggttgagtgtctcttatccaaaatgggaccattttgacaatttccttccctcccttttcttttacccaccccaactcccttccacccccaagaaaacactttactctcctactcgagcatatagtcacgatagccatgggggcagacatctacagtggcagaagcacatggattttggattttttcggatttggggctatgtatatta

SEQ ID NO: 33504 - DNA, 366 bp, Homo sapiens
  misc_feature (1)..(2): n is a, c, g, or t
nntcccctgtggtggaccatggtcatgggtcactgctatggctagatgggggtgatctctttttttctgaatttcagttatctcatctatagagtgggatgagggtaagaatacctcacagcactgttgcaaggatcagatgtgccttagttactataggttgagtgtctcttatccaaaatgggaccattttgacaatttccttccctcccttttcttttacccaccccaactcccttccacccccaagaaaacactttactctcctactcgagcatatagtcacgatagccatgggggcagacatctacagtggcagaagcacatggattttggattttttcggatttggggctatgtatatta

SEQ ID NO: 33505 - DNA, 1184 bp, Homo sapiens
  misc_feature (1100)..(1100): n is a, c, g, or t
tgacgagctcttctcccatcacagccccatgaagaagggggagtcccagatcacaccccctttctctccatttgttggagcaggaaattggcaagaagtagaaaccagtgagcgagcgcactcagggccaagcaatgtgcggctctcccagctgacgccactcgggactgcccaagaccactgagcaataaccacgcctggtctggggtgtccagctcctgggatgcagatggctgaggttggggcacccttgggacagtgctctccagtccaacttgggccaagaaggtggcctggggtccttgctctgcctgcccccacctctactctctactagtcctgtggttgcgcctgtaccatctctgtcccccctcaagtgtgtgtactcactgcacccctattctgtccccctccctttcagaacctgtcttgtgtgtgagggcctcactcctctctcggaggtgcccagaggactgtgggaagaagggcaaagtctctttccagaggagcgtgcacagaccctcatctcccacgaccacacttttggggtgaacagggtgactttgttaggtcgattcttctgcagagatggtgaagtactctatctgcccacccacccactaaaagccatagctccgtccgcctggcctccccccagctctatagcaatagcccccttcccccttccctcctgggcatccagggtgtccagctaggggcccccaccgcactctggtcccagggatcttccagtggcctgcctgcttctcccgaagtgaccccatcagctccacccaactcccatccctcttccagcaaccacagataatgacaattgtttgtgaggtgcttggagatcccctagatgaaaggttctgggtgctggggcagctgactcactgactctcagctgaggtgctggaggtgcctgggaaaggaaataaggcaagctgggggagcacctgtagcagatacagggttccagttttcacagaaattcccctcctccgcccctctctggaaataatggaaacccctccacccgcctgcacagaaccctctgtgcagcagaactcgatgtgaacctttggcatctgctnagtgattttggccaggttctgccctttcttgccaatgatgaaacggtgaagccagagaggggcggagcagggggatcctgtagt

SEQ ID NO: 33506 - DNA, 419 bp, Homo sapiens
ttttttttgagacagagtctcgctctatcacccaggctggagtgtattggcacaatctccactcactgcaacctctgcctcccaggtttaagcaattctcctgcctcagcctccccagtagctggaactacaggcgtgcgccaccatgcccggctaatttttgtatttttagtagagacggggtttcaccatgttggccaggccagttgtgatgactcacgcctgtaataccagcactgtgggaggccgaggcgggcggatcacttgaggtcaggagctcgagctgcaggttatttttagcaaactaacacaagaacagaataccaaataacacatgttctcacctataagtgtgagctaaatgatgagaacaaatcatttctgtgtaacaaattatccctgaacttaagataaaagtt

SEQ ID NO: 33507 - DNA, 303 bp, Homo sapiens
cgcggccggcatttctcctcgcagctcgctgcctcctctatccctgcctccctctcccccctctgtttttctcccttccttccctctccgaccctcttcctctccctcccgatcctttccctcctcctctcatctttcccctgtctctccgttctagctcgtcccccaccccaccttttcttctttctcctcctctccttcctctccccctctcctctgtctccttccaccgtctcccctgcctccctgtctttcagtccctgtttttcagccccgtctccctctcggtttctctcccccacc

SEQ ID NO: 33508 - DNA, 619 bp, Homo sapiens
ctgccacttactagctgtggagacgtggggaaatccattgacttctctgatcctcagtttcctcacccatcaaatggggtaaatagctcctacctctcagaatagccatgtcttttaaatgagatgtcattttctacaaaaagacttacaacagcccttagcacatacagattctgcaattaatagagaactcattttttgggaatttcaggcaggaagggtgtattttgaggctggagatcaggggcacaaggttgccctcatctatgtcaatatatgttgacatacattctccccatggagtggggaggccctatttggcctgaggctggctgcaggaacaagacattgcattcttgagacaggcagtggccttgagccctgttcccttctcatactgtcaccagcaatccctggctgcaaggcctctgagctcaagggaaggttggctgaccaaataagatagctcttatctccatgaagttgcccttggtgggcctggctatgtcctcataactgactccctcacaaggcaagaagcaggagtgtagctcaccagggcatggtttccctgggaagtgtgtcttgggtgactagggatgcccttccagactggacc

SEQ ID NO: 33509 - DNA, 423 bp, Homo sapiens
gtatatgtagcaaccaaacagtttcttctttcctaaaactcaaagtgagtcagacttcttaggcttgtagatgttgaggactaagctttgctctttatcttctctttatggatttccctttggaagcagggataagaagagggaaggtctcccagatgtaaatttctcataaatatttgagctccatttcagtaattctttcattctctgatctgttgcctaatcttctatttagcaagtactttccatgaaatagaaggctttaattgatagaattactaatttgaatagcttagcacagctcagcttgtaaaaaaaaaggaaaaccactatccccattaaattctcatcttgtaaaaccagccatcagcacctccctgtctttttactaaagtttcccttctttggtctttagtgctaagt

SEQ ID NO: 33510 - DNA, 3311 bp, Homo sapiens
gcccccgctccgccgcggagtttctgcatgactgtcacaaagatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccgccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatcaaaaaaaaaata

SEQ ID NO: 33511 - DNA, 3727 bp, Homo sapiens
agcggagtaatgagggaggcagggctagagggtgactagcagccaggcctcccaggctcccaggcctctcagatgcctggaatttcggagctagaaggtagtcagattcccgttatcttgactgctgcagcggggtctctgggatggtgatgtgagtgcctcctgcacccgtggcccccatgtggcataactccttgggcgctattcatccacacggcccatctgtgcagggtacagccttcatggtcttagctggcagccctgacaacttggatgtgcaaagaagatacaagtttgtttcctctgaagcttgtctggtgtcatccaggagccccacctgagtctcattctgttgcccaagctggagtgcagtggcgcgatctcggctcactgcaacctctgccgtctgggttcaagcaattctcctgcttcagcctcccgatcagctgggattacagatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccgccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatcaaaaaaaaaata

SEQ ID NO: 33512 - DNA, 3247 bp, Homo sapiens
gcccccgctccgccgcggagtttctgcatgactgtcacaaagatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccgccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatcaaaaaaaaaata

SEQ ID NO: 33513 - DNA, 2469 bp, Homo sapiens
gcccccgctccgccgcggagtttctgcatgactgtcacaaagatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccgccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgcgctcagtgacatagtccagcgtcaggccattgggcatgtgatcttggcccactgctt

SEQ ID NO: 33514 - DNA, 273 bp, Homo sapiens
gctgggaggcatcaaccgaggtaccacagcggggggctccacagagcacaggcggctgcagcctttgccttcagcgcagctcaccccagttctccttgtctgtccccctgtttgaacttccctcccacccagcctgctggaccatcacctgacagtccatgggatcgtcagtgagagcgtttcccttgccttctttagatcccgtgctgatgtctttgaaagaaggctataagaagtcctcaaaaatggtatttaaggctcccatcaaagaaa

SEQ ID NO: 33515 - DNA, 117 bp, Homo sapiens
tgaagagtaggggctttcccagcagccccccatgtgtcctctcttctgctcctcccactgtagtcagattcctaccaggaagacatttacccaatgacaccaggcacggagccagca

SEQ ID NO: 33516 - DNA, 330 bp, Homo sapiens
tggtactggcataaggatgaccatacagacccgtggaccggaattgagaatccagaaataaatgcatactttcacaacccatcaatttttggcagcggtgttaagacagtttattggcaaaagaataggtttttccacaggtgatgctgggacaactgaatatccacatgaaaagaatgaagttggaaccttatcttatgtcataaacaaaaataactcaaaatggatcaaaaacctaaacttcaaaactcttagggaaaaaaatagatatgtcttggattccagaatgatttcttaaatatgacaccaaaagcacaagcaaccaaagga

SEQ ID NO: 33517 - DNA, 520 bp, Homo sapiens
ggagacacaaacaaatggaaagacatccatgaattggaagacttaatattgttaaaatgtccatactgcctaaagtggtcttaccgattcagtgaaatttctatcaaaattccaatgggattttttgcagaaatagaaaaattctgaacttcatatggaatcacagagaacccttaatacccaaaacagtctgaggaaggaagaacaaagctggaagcaccacacttccaaacttcaaaatacgatacaaaagtacagtagttaaaacatcagctgggttcagtggctcacacccgtaatgccagcacttggggaggctgaggcaggcaaatcacttgagcccatgagtttgagaccagcctgggcaacatggcaaaaccctatctctactaaaaatacaaaaattagcccgggcatggtggtgcttgcttgtagtcccagctacttgggaggtgaggtgggaggaccacctgagctggggaggtcaaggctgcagtgagccatgatcataccactgcac

SEQ ID NO: 33518 - DNA, 474 bp, Homo sapiens
tcggacaccctcacggattactcaataacagccttaaaactcagattaaaaataaaacttaacaaaccttggtttaagttccagctccaccatctggtaactgtgagatcttagtaaagccacttaaaacactctgaacctttgtttcctcatatgtaaaataagaatactatactatttcttctgcctatctcatataaggaagcgcaggaggaataaaacctacccacattgccagtatgttttctattccttctggacagaaaaggtcaactcatataaacagctcacatcagaaaaagaccaaaatgtaacaatcttgtcatcatttttaaatgaaaaagaatttaacctacgtttgaacatttactacacagatataacacatctgttattacaacaaactgaggaaataaagggataaaagattcatgctctctcaaggtatgtgtgtgttgaggtaatccgtgaggg

SEQ ID NO: 33519 - DNA, 384 bp, Homo sapiens
tttttttttttagagatggggtctcgctatgtctgaagtagactggctattcacaggagcgatcatagtacaccctcaagcaatcctccagcctcagtctctaaggtagctgaaattacagtacatgccactgcttctggctgtattcagtgtaattttctcacaatctttgtttaaattaagcgtccgtgtgaatatttagtatttagatactactcagtgtcaggacaagcagacaataggactatggactctttctcaccctacatataggctatcatatttttttctactttctagactcttttccctcaactgctccaaaatctgtcacatctgaatattttccatatgctcaaatgcatcagatactgtttttctctg

SEQ ID NO: 33520 - DNA, 430 bp, Homo sapiens
caaaaaaataaataaataaaaacaaataaataaataaaaaaaatgaagtgaacactaaaccatctaatagataaaccattcagactattcctgttactgcactcagtagttttagttacaaatgatgacaatcaaagttatgttccatggttgagtgcactttgtcttatttgtatgtgaaaactcacacagtaggaagaagttctgtattggttaactgagttctcaactggagacagcactgacttccccatttccctttgcgggtaggtggcattccagattatgtggtggtaagcttttcttttgcggggagagaagacagggcagtactcctgatacctaataactatagagcagacatgttaaacaccctgtaattatcaggccacttccccaactgcagaattgcccatctcacgtgcacaca

SEQ ID NO: 33521 - DNA, 417 bp, Homo sapiens
gccatcgaaatctgtactttcaaagctgtgtgtttatggtttcctttgctttatcacctgacaaacagttcttacatcttgcatgtgatacaagaggtgtatccatttgtatgttaattgaactaggcctgggaaaagatggtatcaactaggagccatgcatgaacccattgttgtaatccatgcctggaaagagacgatttcacattcccattgctgatcctcaaaccacccaaatgcaacaacaggcttttgacctcacttggagataaccaaaatgatatcatcaaatatagacatgcttactacactcttccaaataattactggtatcagccccatttttatttttaaataattgtaatctaattgaataactaatgtatatttcagtgtgggaaatttggaaaatacaca

SEQ ID NO: 33522 - DNA, 483 bp, Homo sapiens
catcaaggggaggagaaggtttgagaataacgttttctacatactgagtttgagaggcctcttgcatattcaagtccacatgtttaatgggtaggtggaaacatgaacctcgatcccaggggagagatctggtgaaagatgtaaatttcagagtcatctttgtgaaactgagagtagaagtcatgtaataaagagatcacccagatggtatgtcgacatgtaaaagagagacaaggatgaaacctcaacagatatcgatattagctcagagaaaagaagaaaagcaaacatgggttttcacggaggcagaaggaggagcagaggaatacagcgacctgggggtcaagattgcaaagcacttcaaggatggaggcccatcatgccaacccttcaaagcaactgtgttgaagaaatgaaaagatgagtcaatggtaaggtcatggttgaccttgacacatgtcctgatggaagttgatttgcaat

SEQ ID NO: 33523 - DNA, 404 bp, Homo sapiens
ggactacttaatcagaaacaatcagaggtaaacatgactgccattagtgctttttaaattatggcctcaaaagatatgtatctgggctgtggatgaatgtttaaaattatgtaagaatgggccaggcacagtggctcacgtctgtaatcccaccactttgggaggctgtggcgggtggatcacctgaggtcaggaatttgagaccagcctggccaacatggtaaaacccagtctctactaaaaatacaaaaaaattagccaggcttggtggcaggtgcctgtaagtcaagcagctcaggaggctgaggcaagagaatcgcttgaacccagaagtcggaggttgcagtgagctgagattgcgccactgcaccccagcctgggcaacagagtgggactctgtctca

SEQ ID NO: 33524 - DNA, 720 bp, Homo sapiens
atgccttccccgagccctgtgaggatacggtctcctatttgaccttatggccatagacagacttgagctaagaatatgaagagagcgttttgatggatattttgacagctttggggtgaatgtctcagttagctattgctgcaatactgctgtgtaacaaaccaccccaaaaccagaggcttaacatgacagtaatttattcccatccacacatttgtgatttagctgggggagtgctatgctggatgcaactttaactagtacttactgtattagctcatgataaggagttttgtaatccagttgttaaacacagccattagtaagaattaaattctgtaagtttacaaataaagaaattatattaaaatagaagatactaaatattcagactccattgcttcctaactatgctgctgtgctctgtgcttgaggttgcttctgcccatcgtgtctctatggtggaaatacttgaggggggtgccactgtgcagctcttcccaccttcgttcagtgacgtcatgataataccttgacattgaccatggtgaaattggtatctacaccacagaaattgcaaatgctacaaatcagggctttaaaacaacaacaaaaacaaatagatgattgtgaagcatttacccacatacccctgactgggagtcgctgatctagactgggcacagttgggcttgaatccagggtgcaggtcagtgaggg

SEQ ID NO: 33525 - DNA, 155 bp, Homo sapiens
aggagtatgtaaactgtggagagaagtagggctattttctacagcagtggtcttcaaattttttaattgggtaccttaccagaaaacatttgaatagaaaacctcaatataagtatgtctaattataaatcatatgtataaatatatatactatt

SEQ ID NO: 33526 - DNA, 857 bp, Homo sapiens
cttgccattttgtttttattcagttcaacttccttgccgctctgtagtttccagaggagtaaagtaaaaattatgagttctgagaaagcaaatttgcttgccataactccatttgagggtgactgcgattttgttagcataagattgaagctaatctcctaaagagtatatctgattctgtgtcttaatcatttttcacaagaaaaaaaaatcgggacatataggtatatgtagagtaacataaagccaccaattgtagaactgatgtgatgtgaattgtactgagggttggcatgaatgcttttctttttcacgtgtaacattaggttcagacatatatgtgtgcagtgcattgctgtaatgtgtgcagatggtaagaacacatatgtctcaataccatgctttatcgctcaatagcctgacagatgtatatgggtgaattcattcattgccctctctgttgattagtagcactttgaaaatgatgtcgtaatttggcaaactaaatcctggtcggggagcagtactgaaagtattgaagaaatgacacgattatagtttgatccttgtacttagaaccttcatcaaatataaggttttaggtcttctgtaatgttaaaaaaaggaaaggaaaaagagctagttttacatatgatgcagaatttgaaaaatttgtctttttattggcaaatgctgatttaaaagtccctgaatcatttcagaatctgtagagaatgagatgtggtattatatgtgatatcacattaaaaagtaaaagttcagtctgtggacaaagtctattaaaatgtttttaatatagtagaggacctcgtaacatgagccactgttagtaaaaa

SEQ ID NO: 33527 - DNA, 661 bp, Homo sapiens
agaccctgttactacaaaaaaaaaaaaatttaaaaattaaccaggtgtggtggcacacacccttctctctcttgctccttctttcgccatgtgataggcctgctcccctttagccttctgccatgattggaagcttcttgagaccctcaccagaagcagatgctggcaccatactccctgtacagcctgcagaaccgtgaaccaaaataaatatcttttctttataaattacccagcctcaggtattccttaacagcaacacaaacggacttacacattgctataaaagataacaagctcaggtcaaagagaaatgaacttgagaccagagaactctcctaagacagcacaagtttacctttgtgaggcttcctagcccaagtctgtttttcttctttaaattttttattgagcagcacttaaaacctgttactgtaaacctccacccactttattttagtactgaaccaaaaagcaaatacatgcctcaaaaaatcactgaatctaaataacaaactaaggttttgaagaaattagcagttctctaatattcaagcaactatgcccaaatcagcattagcccatttaaatatccctgatcagctggattccaaagacctgtcaactatttctttaaaatatctagcacaaataatcatat

SEQ ID NO: 33528 - DNA, 627 bp, Homo sapiens
ggacgcgtgggtcgacccacgcgttcggacccacgcgtccgcctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgctgtcccctaaggaaatccgagcggctacaaagcgtttctttacttttcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatccta

SEQ ID NO: 33529 - DNA, 285 bp, Homo sapiens
cctggccctctctggaaattattttaataagtggaaaaagaacattaacctctccccatcttctcagtgtgtctttttattatttctttgctgaaataatgtagaattgtgttttttaggtaaatattgcagattttcaagagaatcagtgggtgacttgtttccaggagtctgctgaagctatccttggacaaaatgctgcttatcttggggaattaaaagacaagggtatgttagtggtttttggttagagagggagagagggtcaggcagagagggtccagg

SEQ ID NO: 33530 - DNA, 2875 bp, Homo sapiens
cgcacgtcgggggcgggagcggtgcgcgcaacttctcgggccaataactgcgcagcgcgcgggacccgggtggggaagctggagctgttgcggggtccgcggggaagtcttggcggtggagccatggtcggccagctgagcgagggggccattgcggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcctccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgctgtcccctaaggaaatccgagcggctacaaagcgtttctttacttttcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatccta

SEQ ID NO: 33531 - DNA, 2861 bp, Homo sapiens
cgcgagcggagagcgaaccccgagtagagcccgtgtaggcagctcgctctagccggccgtccggccggcgctagttatcgcatcatagccccgtagtagcccaagttaccgaaggcgggcactcagggtgaccattacatgcgcaagcggtgagtcacagcgacggccgaggaccactacctacgacgtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcctccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgctgtcccctaaggaaatccgagcggctacaaagcgtttctttacttttcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatccta

SEQ ID NO: 33532 - DNA, 3157 bp, Homo sapiens
cgcacgtcgggggcgggagcggtgcgcgcaacttctcgggccaataactgcgcagcgcgcgggacccgggtggggaagctggagctgttgcggggtccgcggggaagtcttggcggtggagccatggtcggccagctgagcgagggggccattgcggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcctccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgctgtcccctaaggaaatccgagcggctacaaagcgtttctttacttttcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatcctaaaaaaaaaaaaaaaaaaaaaaaaaaaaaaaaaaaaaaaaaaaaaaggggggggggggaaagagatatcccccgagggggggcacacagtaatttatgcgccggtaaccacgaggttttgtgtgtggcagaaagaggggggccccataatagggaaggatctacaataaaagcgacacgagcactggggacgcgagtttataaaaaggcgtccggaagggggaaaacagctgatgcagagtggggaaacttggggaagaaagaaacacacatatcgcggggga

SEQ ID NO: 33533 - DNA, 3392 bp, Homo sapiens
cgcacgtcgggggcgggagcggtgcgcgcaacttctcgggccaataactgcgcagcgcgcgggacccgggtggggaagctggagctgttgcggggtccgcggggaagtcttggcggtggagccatggtcggccagctgagcgagggggccattgcggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcctccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgctgtcccctaaggaaatccgagcggctacaaagcgtttctttacttttcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatcctactttctttgaatgcaaagagttcctataactggaaagcaattaattagccttcataataaatgttcacttgggggggatgttaactcattataaacccgaagattagtccaaggcatggagatccttcttcctagtgtttgcagccctgaaatgcatctttcaaagcatgaaaacactaaaaacaaaaagccattttgcctgaggatgctgatgatctggcacttgggattttattgatgtttacgcagcagtctaacaccaaccacgctttgaaatgtgtacagacagtgagctggtaagaaaacagtaattatgctagtgggcctttcagtcagcaaaagcatgctcgctctgtgtgttcctaatcatattaattatctatccggtggctgcaacacaccgcctgccattggccgcacatctcgccgtcgtaccccggcagtgcggcggtcactctgcagccagaggacctgctgttcatcactgcacatgccgcctgcggaggctttttggata

SEQ ID NO: 33534 - DNA, 2559 bp, Homo sapiens
ttacattacgagagggttaaacccgggagttgttctagggtggtaactgactctcgtccctgcagtggcaaaagcacctggcgtctttcgtaggtgctatatcccgcaggaccttactcataatctcaggctctcagttccttgctgatgggccttgaaggtccagttgattactcagtgccttccctatctatcatgtaagggttctcatacccaacacacctcctgaatagtcgggcgactggatgtaatagagctttgcaatctatggtgcaccatgcaaaggagtcagtccctcacctggctctgccaaaacaggcatgcagcttggaggagagaagtttatacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcctccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgctgtcccctaaggaaatccgagcggctacaaagcgtttctttacttttcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatccta

SEQ ID NO: 33535 - DNA, 2948 bp, Homo sapiens
  misc_feature (2905)..(2905): n is a, c, g, or t
cgcacgtcgggggcgggagcggtgcgcgcaacttctcgggccaataactgcgcagcgcgcgggacccgggtggggaagctggagctgttgcggggtccgcggggaagtcttggcggtggagccatggtcggccagctgagcgagggggccattgcggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcctccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgctgtcccctaaggaaatccgagcggctacaaagcgtttctttacttttcacttcaattaatgctgcgcttcgcttggtgagtgcgtactttttctacctgtacacattcctgcattcatgtattttgtttaagtttagtagtaaaagactggttaatgataacaatgcatcgtaaaaccttcagaaggaaaggagaatgttttgtggaccactttggttttcttttttgcgtgtggcagttttaagttattagttttnaaaatcagtactttttaatggaaacaacttgacaaaaaattgt

SEQ ID NO: 33536 - DNA, 2831 bp, Homo sapiens
cgcacgtcgggggcgggagcggtgcgcgcaacttctcgggccaataactgcgcagcgcgcgggacccgggtggggaagctggagctgttgcggggtccgcggggaagtcttggcggtggagccatggtcggccagctgagcgagggggccattgcggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcctccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgctgtcccctaaggaaatccgagcggctacaaagcgtttctttacttttcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatccta

SEQ ID NO: 33537 - DNA, 1751 bp, Homo sapiens
aatctagacgatccccacctcctaccccacgaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcctccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgctgtcccctaaggaaatccgagcggctacaaagcgtttctttacttttcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatccta

SEQ ID NO: 33538 - DNA, 1200 bp, Homo sapiens
  misc_feature (18)..(18): n is a, c, g, or t
  misc_feature (20)..(20): n is a, c, g, or t
ctgggatgcagggaattngnacgagcatgtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcctccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgctgtcccctaaggaaatccgagcggctacaaagcgtttctttacttttcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatccta

SEQ ID NO: 33539 - DNA, 2276 bp, Homo sapiens
cgcacgtcgggggcgggagcggtgcgcgcaacttctcgggccaataactgcgcagcgcgcgggacccgggtggggaagctggagctgttgcggggtccgcggggaagtcttggcggtggagccatggtcggccagctgagcgagggggccattgcggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcctccctcgtgcgcatctcagaacccatcggtaggcaaaggaaaatacgctcaggtggttgtggtgtagactgtgtcaggcctacggagtcagccagtggctagcgcaagaccagtcactccctctgccttcaggctttggtccctgccgggatcctcagaatcgcggacgaag

SEQ ID NO: 33540 - DNA, 621 bp, Homo sapiens
  misc_feature (592)..(592): n is a, c, g, or t
cgcacgtcgggggcgggagcggtgcgcgcaacttctcgggccaataactgcgcagcgcgcgggacccgggtggggaagctggagctgttgcggggtccgcggggaagtcttggcggtggagccatggtcggccagctgagcgagggggccattgcggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaagaagctgaaaaaaaagtcattacttcagataattctagagaaaggcaaaaagaatcttcaaatcactggccccattaaaggaaaggattgtttgcccttacaccaagtncaaaacataaaagcctcatttgacaccaa

SEQ ID NO: 33541 - DNA, 1165 bp, Homo sapiens
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 33542 - DNA, 1692 bp, Homo sapiens
ccaaccctgcacctggccctctaaccaattctgagtgcccgtagaaaaatgtacatgtaaagacaccagattttagggaagtaattctaaatgtttattttagctactgaatgtgttcattcatagtttttgtgtcatatccatgtctgccaactcacctttcacaacagaatcttcttttcagggagatgtcctttgcttctcagatgtaaatgcactttaagtttgttattcaacagtgaaaatgagtcatacagaggtaatattttcgtatgttctgcatcttcagggttcctgggttttttgtttgtttgtaattatgtggcttcagagtaattttattttcaactttcactgtggggaggcagtataggcataagtggttaagagcgaggaatctagagcagactaccctgagtttaaatcctagctagcggctatataaccttgggcaagttacttaatctgctgtgccttatctataaaatggggataatgatagtgcttgcctcacagaattgttagaaaagtgaaataagttaatacatataaagcacttataataatacccgacacagtaagcacttaactactattattaatatcactactttttatttggaggctatgacttgaattatgagcctcacagagcaaacatatatatagctgttcagttgtcttaataggcaagaaagtaatttttgatccctttattctcttgaattccaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 33543 - DNA, 1090 bp, Homo sapiens
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccgggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 33544 - DNA, 884 bp, Homo sapiens
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccgggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 33545 - DNA, 342 bp, Homo sapiens
taggcaggggagagaggaccttttattaaatatcaacagaacattagtctagtatcctcttctttttctctttagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattaccatcagcaggagtggtacgcagcagttccttttcagttccttaagagctcttcagtggaatgctaattagggattcagtaccataaagcttggaaagatctattaactagag

SEQ ID NO: 33546 - DNA, 1440 bp, Homo sapiens
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaaaaaaaaaaaaaaaaaaaaaaaaaaaaaaaaaaaaaaaagaaaaaaaaaaaaaaaaaaaagagagaggggggcggcgcgccccaaaaaaatccccccgggggggccccactgcacacggcacacccacaagttcttggaaaaaaagaaggggcccccaaaaaggggcgcgacaatatcaaacagacgagcgcggggacgccgagataaaacaacgcgaggagggaaaaacacgatcacggggcacaccttggaaaaaaaaaccaacaccgcgggga

SEQ ID NO: 33547 - DNA, 1083 bp, Homo sapiens
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatatt

SEQ ID NO: 33548 - DNA, 1386 bp, Homo sapiens
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaaggtggcttttgtcttattgataggcaactgagaaattttgcagagcagcgttatcttcagaaaaggaaaacattatggttaatctagtcagagatttatagaatgcacacatctcttcaccttatcttttaataaatcacaatgaaaggataggagtggacatatgtttcaaatatggggaccctgaagattttttagaatgaaataaagatctttaattc

SEQ ID NO: 33549 - DNA, 1093 bp, Homo sapiens
tccgctaagttcggtgcccgcgggcaccagccggtgggggcttcgtccgctttgccggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 33550 - DNA, 1110 bp, Homo sapiens
cgaccccgaggagacgcggcccacgctgggagggagcagccaggacaaaagccggtcgtcgtggggtcccgcctgggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 33551 - DNA, 959 bp, Homo sapiens
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 33552 - DNA, 1114 bp, Homo sapiens
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagtggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 33553 - DNA, 877 bp, Homo sapiens
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatatt

SEQ ID NO: 33554 - DNA, 1180 bp, Homo sapiens
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaaggtggcttttgtcttattgataggcaactgagaaattttgcagagcagcgttatcttcagaaaaggaaaacattatggttaatctagtcagagatttatagaatgcacacatctcttcaccttatcttttaataaatcacaatgaaaggataggagtggacatatgtttcaaatatggggaccctgaagattttttagaatgaaataaagatctttaattc

SEQ ID NO: 33555 - DNA, 294 bp, Homo sapiens
aggctcctctgtgagcgctctgccccttctcagctgctgaactccagtctcaagataggtgaccctggggctcaagactgtctctcccttcccccttcaggttcctttggagtcaggagtgcctggagtccaggcatgacttccccctggcttatctcctctttacctgtgtcctgggaacacctgaaagaagctgggggagacaatcatttctgcagacacagggttacccccatgtgaagcaagcagcaaattgatcttatcacatgcctctgaccggttagggaggcgagt

SEQ ID NO: 33556 - DNA, 331 bp, Homo sapiens
tataaatttaaatgttgacattttaaaagtttgccattgatagtgatctttaaaaaaacaactttcagattgaaatattcaattaaagcaataatcggttgctgttggttctttgtatgtcacgctaattacagattttctcctacttatatcaagatgtttaattcagtacctagtttatcttgattataaatttagattcttttcctgaaccatggaagttgaatataaaactgtcagaagatatttatgtactttatttagacataatttatataattaattctaattggtactatagttgttagagagaaactagttaaaagcaaaa

SEQ ID NO: 33557 - DNA, 1108 bp, Homo sapiens
taggcattcaatttcttggacttgtttttctttattattgctttttagcagtcaatattgctatatctctaccatcttatgcatttattccaaaatgattgattgagccacccagtgttgaaaaggtagatgttattgttgtttccttgtttggtcagttttattggtaattgtatcccctagcctgttctcaaggaggtcacagatgctggggttgggccccgggcagttgcagcacagtgcaatgagtgccatgacaggggaggcagagtgctttgtacactcatcgggagtccctcatgcaaacttaggagaagcccaagtggaaggctttgggaagaactaagtgacacctcagctgaaacttgatggctgagtaggaatgtctgacaggtgtgaagaactgacgagagtggggctcagaagagtgatatgggtggaggaaattcctgtaccaaagctgagaggactagagaaggtttcccgtgttccagaaaacattaaaaagattcattgtggctggggagaagagcacaagtaggagagtggccagagtgggagggagacatagacatcctgcggcaatgagaaactgctgcagaggaagaaagtgatcagatttgggtgatttccaaaagttagttgcagtcaagattttagtaaacaaaagaacacaggaggcaagccaggatagcagcccctgctttgcaggatgacattaataaggcatagttattacctttatggcatctatactttggccttggaaatccaaaaaaagaaatgtagataaccattcacctatgccctttgtacttgcaaagggtcattctttctagaagcagagcctgtcaggacagggacaaggcttgcagagaacactgtgaaaaaaaaaagactaaaaagctccaggctccaaaggcaaagtgggttccaggagtgtgtaagtggtgcaggaaatatatcacccaatctgacttgagaggctttgctgagcccccagccagtgaccctgcagacagggatgataaccagctgagggaacgtctgcggcagactctgagagaggagctctggctgccaggcctgactcatgctgagtcttcca

SEQ ID NO: 33558 - DNA, 393 bp, Homo sapiens
tagtgctggactttccagagacagggtttctacatagtagctcacaactgttccaaggagtaggagaaacacattatatgtctggtaattttttttttaaagacagagtctcactctgctgcccaaactagagtattgtggcataatcgtagattactgcagcctcagtctcctgggctgaagccatcctcctgcctcagcctcccaagtagctggaactacaggcacatgccaccatgccaggctaattttttttttcttttttttaatagagacagggtcttgctatgttgcctagtctggtttcaaactccccagctcaagcaatccacccacctcagcttcccaaagtgctgggattacaggcctagaaccacgaacctggacctgcta

SEQ ID NO: 33559 - DNA, 399 bp, Homo sapiens
gagattggctaaggcagtaaataaaacttagaaatgctcaaatttattgtaaattgcttttataatcattgatatataaagcatgctactgctaatcaattagttttatgtattaagacctatcagcatgtcttttttttagtatctggttgacttaaacatgatgttctctgtaccatttaacattttcaagacatattctccccaagcaaattctgttggaaccaagtgtttccagttctagaagtttacttctagagtcttcatatgaaatttacagttgggctttcatagggttttaatttgcactgaatccttccttctgaaagatgacttatgtttaaagtataatgtagcagtgcttttgtcttacaattaaactcttacagcactcatgca

SEQ ID NO: 33560 - DNA, 414 bp, Homo sapiens
gagtcaggagcccgagggtgctcggtgagtacgtggtgactgattgttactttacacttaagcctgaggaaacccagccaagattcagaggcacttgttcattcaaatcccaagtcaagaggttgagagtcaaccagggaggggggaaaaacaccatggctcaggtgggcttggcagcacacaggtgcccaaagcagagggcttcccctccaagaaacttcaggagataaggaaaaatcagaaagtaaagggcttcagcttgagcattttatatgcaaacagaagggaggacaaaataaggataggggcaaaaagaggagaccactgcagctgtactccctctcagaagagatgggactgcttctgagagttgagccaggcagagatggacaggccattcaacgtgagatctgg

SEQ ID NO: 33561 - DNA, 436 bp, Homo sapiens
gaggaaactgggaaggtttgtctcatccttcagcccaaactttaaaaccaatggtgttgaatttttgatacacaaatcaatgcattaacatcatgcttttacttggcagaagtaatatcatggattgccatggatatagcaagttggcccaaagaggagaggactggagacttggaagctaggggagcatattttttggggtcacatgggtgatctggaacagccctgaggtgggtgctctgcagggatccggacgaacataggccttgcatcaagaacatctacagtatctctaggacacaggcaggagaagcatggtaagagagagtggtagaagtagggtctgactgtgggtaccaggttgaagtcctagagggcaagcctcaggcatcacagagattgagctgtacatctttatggttgaggcaaaaaaaaa

SEQ ID NO: 33562 - DNA, 280 bp, Homo sapiens
tgagacagggtctctctctgtcacccagattggactgcagtggcaggaacacggctcactgatgcctcgacctcctgggctcaagtgatcctcacgcctcagcttcccaagtagctaggactacagatgtgagccaccacgggcccgctaattttcaaattttttgtagagacagggtagtgcccaggttggtcactgcgaattctctagccaagaaatgtctaagtaaagtgacaatgcttatagtcatcaactatttacttaggggagtcccagagca

SEQ ID NO: 33563 - DNA, 300 bp, Homo sapiens
gctcgacggagccactgcactccagcctgggcgacagagccagactccgtctcaaaaaaaaaaaaaaaaaaataacatttgggtatcaatcaggaaggctggagatatggacacagggcaaataaagccaaacagacacagagatatgatttacactgttttgaaatcactgccatgttcaaattttcatatggccaacttctgctcataattagaattattaaaaagaaaactggttcaatcgagaccatcctggctaacagggtgaaaccccgtctctactaaaatacaaaaaaaaaa

SEQ ID NO: 33564 - DNA, 2624 bp, Homo sapiens
aagaatgtatagtggcttaggttatttgaggttttcgttttgaatatatatgttgttattttgatgtagatacgttagcagatggagaggttctaagagattggatactttggaatgtctttatataggaaatagacctcccatttcttaagcaagttgcttctggaattgatgcaacagggatattagctgtagtttaatggataagttgttctatgagctgctgctatcagtatttttttccacattttccattgatatttgtgatgcttgaaaaatccaaacttcacttggatacatttaattttatgcctttttctctctacctcccacttttcctaggcacccttgcacattttgttactgtgaaggactattgccctgttacctcactgataagaaatctcaactgtattcattcagaatgctttaagcttagtcataaactacatttgcctatggacctttggttattttgttaatgttgtcattatatttaagacttattgtaggaagtaattttaaatctatttcataacctgttttgatctgtctgcatactgctatatgttaatttattacggccttttacaattcacttgtcatctgagattgttctagaaactgatgaggaaagagtcgtactaaccaaaatgaatgggcaattgacataacattctatttcaggtttccttgtacttggggagccaaagcacaagatctaaggaaatcttattcacatttgtccctcagagcatcttaccctaagccacagaggtataaatagtaagatgagaattgctcattgtctgactccttgcacagcatgaatttaattctagttggaaacaaagttagtgttgactactggttaccttaaagtattcaccatactatatatttattagaccatctttcctctttgtttattcaagactatgtacttataaaagagaacctataagaatgtgtagagtgaccaaatagggacaaagtgacatacctagagtttgctgctcaaatttttccactagcgtaaccctaaagcagaggggcatgatgaagggggaaggggttctgagagcaaaatcagaatcagcctaccactgacatgaagtgtgttctgtctttaaaatgtaagtgaattttgcattctctataataaaacttttaatataaaaatgatatgtttaatctttactgaaacttatgccaccacaaaggagcaccatgttcatcacgtggctgctcagttttctcccccagtgccctcacccccagtggaggcaagtccttgagctacacacactggctgtagtgcaagatatataaacataggccgggctcggtggctcatgcctgtaatcctagcactttgggaggccgaagcaggtggatcatctgaggtcgggagattgagactagcctgaccgacatggagaaaccctgtgtccactaaaaatacaaaattagccgggtgtggtggcacatgcctgtaatcccagctactcgggaggctgaggcaggagaatcacttgaacccaggaggtggaggttgtggtgagccaagatcgcgccgttgcactccagcctgggcaacaagagtgaaactccatctcaaaaaaaaaaaaaaaaaaaagatatataaacatagaacatatccagactatttcctgcccttggaatctgaccttcagaaggattaacgccaaactaaactgacctgaaacagttttgttactattggcattccttgactaaaaaggaccacctgatgctcagtcccgagagtaggaatcgtggtttattatttttcatatccataccacctagttcagtacctgttatagagtgtttaattgctgatactaggaattaagggattttttaaaagtagcaaatagtttaaggaacaatcaaaaaatgaattttctaattcagttttttcaatgaagtcccatcactgaactttataatgtaatgtttattaagcagacatccccttaaatactcagtttctttggagagagcaaagcatatctctctgtggaaattatatataatgcctggtattttacactcaaagcaaggtgttggccaggaaggtaaagaaatggtgtctatgtagacttaatatcactagtctaagtgtcattttgagcctagtagcactaccttccaagtgagtcacaacaaatttgatcctatttggtatgtttttgtccactgttatgattcatcatgtatcttacaagagccactcaagcaagactctgcttctatgtatggtgaggccttgttgttctaggctagaataaactctttgtatgcctcattgaatatgccaggtaaaatatatgcagtcaagaatgaattatttttctgactaaagtgtgtagcagtagttcaaaattgtgcccttgttttaacagtttctgtcaacatcttctcatttttccctacaaaaacaccagggtgtattataagtactgcctgtgagaatttgcactttatgtatttgtgtgtggatttcttgtggttttagccaaatgaagtgttatcagtaataaacaggtctcttcatagaaaaaaaagtcgacgcggccgcgaatttagtagtagta

SEQ ID NO: 33565 - DNA, 2570 bp, Homo sapiens
aagaatgtatagtggcttaggttatttgaggttttcgttttgaatatatatgttgttattttgatgtagatacgttagcagatggagaggttctaagagattggatactttggaatgtctttatataggaaatagacctcccatttcttaagcaagttgcttctggaattgatgcaacagggatattagctgtagtttaatggataagttgttctatgagctgctgctatcagtatttttttccacattttccattgatatttgtgatgcttgaaaaatccaaacttcacttggatacatttaattttatgcctttttctctctacctcccacttttcctaggcacccttgcacattttgttactgtgaaggactattgccctgttacctcactgataagaaatctcaactgtattcattcagaatgctttaagcttagtcataaactacatttgcctatggacctttggttattttgttaatgttgtcattatatttaagacttattgtaggaagtaattttaaatctatttcataacctgttttgatctgtctgcatactgctatatgttaatttattacggccttttacaattcacttgtcatctgagattgttctagaaactgatgaggaaagagtcgtactaaccaaaatgaatgggcaattgacataacattctatttcaggtttccttgtacttggggagccaaagcacaagatctaaggaaatcttattcacatttgtccctcagagcatcttaccctaagccacagaggtataaatagtaagatgagaattgctcattgtctgactccttgcacagcatgaatttaattctagttggaaacaaagttagtgttgactactggttaccttaaagtattcaccatactatatatttattagaccatctttcctctttgtttattcaagactatgtacttataaaagagaacctataagaatgtgtagagtgaccaaatagggacaaagtgacatacctagagtttgctgctcaaatttttccactagcgtaaccctaaagcagaggggcatgatgaagggggaaggggttctgagagcaaaatcagaatcagcctaccactgacatgaagtgtgttctgtctttaaaatgtaagtgaattttgcattctctataataaaacttttaatataaaaatgatatgtttaatctttactgaaacttatgccaccacaaaggagcaccatgttcatcacgtggctgctcagttttctcccccagtgccctcacccccagtggaggcaagtccttgagctacacacactggctgtagtgcaagatatataaacataggccgggctcggtggctcatgcctgtaatcctagcactttgggaggccgaagcaggtggatcatctgaggtcgggagattgagactagcctgaccgacatggagaaaccctgtgtccactaaaaatacaaaattagccgggtgtggtggcacatgcctgtaatcccagctactcgggaggctgaggcaggagaatcacttgaacccaggaggtggaggttgtggtgagccaagatcgcgccgttgcactccagcctgggcaacaagagtgaaactccatctcaaaaaaaaaaaaaaaaaaaagatatataaacatagaacatatccagactatttcctgcccttggaatctgaccttcagaaggattaacgccaaactaaactgacctgaaacagttttgttactattggcattccttgactaaaaaggaccacctgatgctcagtcccgagagtaggaatcgtggtttattatttttcatatccataccacctagttcagtacctgttatagagtgtttaattgctgatactaggaattaagggattttttaaaagtagcaaatagtttaaggaacaatcaaaatgtaatgtttattaagcagacatccccttaaatactcagtttctttggagagagcaaagcatatctctctgtggaaattatatataatgcctggtattttacactcaaagcaaggtgttggccaggaaggtaaagaaatggtgtctatgtagacttaatatcactagtctaagtgtcattttgagcctagtagcactaccttccaagtgagtcacaacaaatttgatcctatttggtatgtttttgtccactgttatgattcatcatgtatcttacaagagccactcaagcaagactctgcttctatgtatggtgaggccttgttgttctaggctagaataaactctttgtatgcctcattgaatatgccaggtaaaatatatgcagtcaagaatgaattatttttctgactaaagtgtgtagcagtagttcaaaattgtgcccttgttttaacagtttctgtcaacatcttctcatttttccctacaaaaacaccagggtgtattataagtactgcctgtgagaatttgcactttatgtatttgtgtgtggatttcttgtggttttagccaaatgaagtgttatcagtaataaacaggtctcttcatagaaaaaaaagtcgacgcggccgcgaatttagtagtagta

SEQ ID NO: 33566 - DNA, 706 bp, Homo sapiens
tctctctccagcctgggcccctaccctgagctctagatgctgatgatacacaactactgcctgacatccaaatcactggcaggcaccttacatttaaatcatttgaactggagcagctagctcaggccacaaatccaagtcacctttagtttctctttttcttcacatcccatgatcagatcatcagtagatcctgtttgctctccctgtaaaacatatcctgactccatctcttttcaccacctttgctgctaataacctggtccaagccaccacagtgctggacagtgctgtgacagcctcatgaccattcttcttatttccatagttcctcctgagtcccacagagaataatgtttttaaaacatatcccagctctaaaccatccagcagtttccattagaataatatccccagaccttaccatggtctataaggccatctgtactccatttgctacctgattacatctgatgcatctcctacccgtctccctactctgccattccatccacacaagttttcttgcttttcctgaaatatgtggtgcccctttccatttcaggaccttggcacttgctgttactatgaatttgagtagaataacccctgccaaagacctctgcctgcttaacctactcagtctagaagtctgtctcccattcttctccctggtagtctctaaccctatctttatctttcttca

SEQ ID NO: 33567 - DNA, 453 bp, Homo sapiens
aaagtgtccataataatttctcatttttaaagataaattttggcatgactgtggtaaccgtatcagaaaattttggtagcaatgttagagaaagacttagaagtgaatctctaacatatataaccacacagcattagccagaccttttaaagaaatatgagaaaaaggttaaaggcttaatcgactcagccaaatttatccaacaggatgatagaactaggttttttgtatttctagttttagtgctatttcttttggataattttgcctttttggttttaaaagaaaatgttcactagcctctgctctctcattttagtaaccagagggatgggttacctgagatctgttgttaactagacagaatgtgagtaatggagtgggggtggcctctagaaccagtcttttctcagataactcaattcttcctcaactatgaataggaaaaaaaaa

SEQ ID NO: 33568 - DNA, 397 bp, Homo sapiens
tctgggaggtgaggagcatctctgcccagccgccccgtctgagaagtgaggagaccctccgcctggcaaccgccctgtctgagaagtgaggagcccctccgcccggcagccaccccatctgggaagagggaagagtgaatataagtgtggcctgagtgaaaaggagattcagacacgtctgtaagctggtgaggccgggcatcggaaaccctatttacgcgactctgaggagcctcctgagaagccaagctctgtgccgatgggatcagacaccactgaacatgtccacggtgcttgggggcttggacaacagcagtctgacactgagacacctgcaggcacggagttcatcgtcccaggggaagtttgttacagtaaatgtacatcacagttttgt

SEQ ID NO: 33569 - DNA, 362 bp, Homo sapiens
gatgtgacccatgcccacctctttattctcccttccattattcttccatgatatgggacttcttatagctcccctgctgccacttagatattgttcagaaggtgctgttgagctgtaagatacattacattgaatattgcctttgtgttgcccattccctttgttagtattaaatataataggaaagataaaacgcaagttttaaaaactcagaaaatgagtaaatgataaacaacagctgagattttaaaaattcaacagatgtctgtaggaacaaagagggctctacttgaattaaagtgggtgagtacagcttacaaatgttctatgcatttaccttagttttagtatttcacattttt

SEQ ID NO: 33570 - DNA, 304 bp, Homo sapiens
aagtctaggaggtagacaagggtcagtcgattcttcaaatgtatgatcttgtaatgatctggttttatttcaacaaggtgttttaagtactttcacacttaaaacaaaatacaagttattatgttgagtatcttaatgctatctctataatggtctcaagcatctgtagaaaaatggcacgtgtaatagcacagctgaaacagagtctcaaaatatacaattgcaaatttaaaaacatattttacttggtgtaataaatcttatacccagtgtaatgaaattataatattggtaatcaacagtc

SEQ ID NO: 33571 - DNA, 1345 bp, Homo sapiens
ccaccacgctgggctgttttacaccagttcttttggcactggggacatagacacattagaatggaaataactcactgatatgattgagggctttctgggcaactccgtaagtcttagcacagcctttataaattttcccacaattgtcatctcacacaaagaagtgagacaatttaaggcctggacagggccgtctggtaagtaccttcatctctcccagatttcttatctgcacagtgaggattatatagctactattttgtagtgaagatcaaatgcattcatacatgtacagcacttagattactgactgacacataaataatcaataattattagttgttaatataccatttattctttacacggatgcagagtatccactttatagatgagaacaaaaaagaaatctcatactgtataaatgatttgtcccaaaccacaaggctagacaaagtcagagatggactcatgcctggtcaaggtgtgtagggtgagtggaggagaggatgaactcagtttccaccaggtgagctccactacactttacctgcaggagccagtttggagagaggaaagttatttgaccaaggaacagtggctatgaaaccaggcagaccttgtttaaaatttatctttatcagctactagctgtgtgggccttggcaagtcacttaacaattccaggtacgtgtttcataatttgtgaagtagagctaataatgctgggctcctaaaattgctatctggtaaaagaaaatatcatagcctgtctatctctctctctatctatccatctacctgtctgtgtgtctgtctgtctattatctatctatctatctatctatctatctatctatctatctatggtatctatctactaattatctactattatctatctatttatctgtctgtctatctttctatcaatctattatctatctcctatcacctatctacctacttacctatcatctatcttcctatctactctcctatctacctacctatttaccagtctattatctacctatctacctacctattatctatttatttatctatctaatctagctatcatctatcttccataaacttactcagaaactagcacttacagctgctcaagataaatgtctttttcttgtcctgccctcaatttgtatagcctatggctgggtgagtttccctttgccccatgcaccatgactgccctgtggacaaggaagtgtctggtccacccacatctctcagacaagttcagtgaatatggtgtacccaaattgttggttgggttgcagcaaattctagggggcaaagggatatcttctgtgacctgcta

SEQ ID NO: 33572 - DNA, 727 bp, Homo sapiens
atctcgaaggggaaaaaaaaaaagaatgttgtatatgatagataagttcctaggcgggcctccaaaggctcatttaatctttctacagttacttatacgaacttttgattttccctctatttaatagactattaggggctatatctcattcatgtagcacctactcatgtggcttacagatcataggaactaggtgtcttaaatcttaaattcttttttgaacaaactgtactgtaaaatatatatctgtagaggaaagaagttaattcagtgtttgttcatttgaattgaaggtgaagctaaaagaacaacccccttcttatattacaaaaactgcattctcttgtgtatgatgagaaggaagtgcaaaatgcgtagggacaaggaatcgcctcttccctgctcaaatggttaagcgtgcatcagaaaggaatttcttggccgggcacggtggctcatgcctgtaatcccagcactttcggaggctgaggtgggtggatcacttgaggtcaggagtttgagaccagcctggccaacatggtgaaaccctgtctctaccaaaaatacaaaaattagctgggcatggtggcgggtgcctgtaatcccagctactcggaaggttgaggcaggagaatcacttgcacccaggaggcggaggttgcagtgagccaagattgtaccattacactccagcctaagtgacgagcaaaactgtctcaaaaaaaaa

SEQ ID NO: 33573 - DNA, 216 bp, Homo sapiens
ttttctgtttgaagagggcttttattgttgtactcaagagcgttgtttctggagacaaagctgcctgtactttaatagacagattctgaaaaaaatttgaaacataagccataaaattttatattaataaattcaagacaaagcagaaagcatagatttgctttcagcattctcaaggagcttagttttttattagccaccttattaaaataattt

SEQ ID NO: 33574 - DNA, 398 bp, Homo sapiens
ctttttaaatagagcttcttaaattcaaagttaatgttactttctacagcttgttgtctccttagaaaatagtacaaggtaatacgtaatcaagtcctaaagtatttggtataacttgtcatgaaggagaatgatcactgtgggctgagttagtgcaagaatgcttcagagacatttccttgacactaacctcctaagaactgcatcttgagatatgctgccctgatctgtgttgtttttgctacacagctgaggaaaagaggtacatatcctcctctaaagagctggcacaggaactcaccaaagggcattttgtacatattgaaaaacagcacctcataagaccaactacatttagacttctccagaaatcccatttatgcccctttttgcagagg

SEQ ID NO: 33575 - DNA, 1695 bp, Homo sapiens
  misc_feature (1059)..(1059): n is a, c, g, or t
gaaacacaaaaggagattacagagagatcagagataagaggtgtacctctctgtgttccttgtcacatagcgcgcgcgcgcacatacacacgcatctgtacacacatgcatgctcagccgtacacgcacgcgttccttgctactgccatctaaatatatgcaccgacactctatgccctgcaacgtggccggtgtgtttgtcctgatcctacataaaggtaggcaggtatgtgggagagtccaggcaggaacaaacagccacgcgcaatttaactgcagccaaactcaaagagaccttgagcctgccgaattgtttcactcagccaggtgccccccagaaaccggctattctgcaatcagttgtggaatcctgcaattattcataaaatgtgctgaaaatgtattttaggaaacgtaatcttgctatatatggcaaggtaaaggcgaacctgaaggatgaatgtgtttctgctttttaatgtcatacgtgtagccatctgaccactttttattgggtgacatatcatatgagcactttggtgtaggcttggaaaaactacagccagaggtaaggctggaaattccataagagttaagggtgctgaaaatggatgctggatagtccagcatgaaagatggcataccgctttaggtttgaaatagggggaaatacatgtgaatatttatacatgaaggccattggggagggctgagtcttggcctgagtatctgtgcaggtaagtcattcataagaaaactaattacctgtgcatgtacttggacttgtttaattgaataagctgcatgtgtgcatacttgctgttctttcagggtttgcaattatagattgagtcttttttaaatgatagcttgggggaattaaaaggtggaaaaaagccatcgtgctgcatagctatattgccaagaaagagaatccgatcctataaacaagattaccattgcttgaaatctaactcaaggcctgtatattttaagccacatcaactggtttaatatagccaattgttttatttgtgtatttgctttcatttcaaagtnaggaatcaaggatgcttttcagtcaagataatgtgccttgtttccagccatattaagataaaaatgaaactcagtaaattttgaatgcagccaataaggtacaacatacaacatggttgaaaatgtcttccttgcagaaggctgtccattgctgtgtctacccattttaaaatatatatatttttttcaataagaaatgctagaaagcaatagggcggggaatgccgcacctctcaggcaatcagcacaaaaattatttagaaatctttggaatcacttcacttatacatacattatctcgaaagcactggccccgaactgtgtttctgctaatatgaagttaattagacaatcaaactttgagccttgagcgatgggcactacagcccatcaaggtatgtcaagaaagaaaaaaaaatgtgtattttcctttatgaccaaaccaggaggttatacagctggcattgcatacatgacagatgtgcatatttgtaaccttaaataaacagaagcagggaggtaactgtgtatattatctagcaagagacagcagcagacactcgccaaaaaagacagaaagggacaagagagacacatagacataataaaataacaacaataaaaatcctccaaaaa

SEQ ID NO: 33576 - DNA, 348 bp, Homo sapiens
ttttgtatttttagtagagatggagtttcactgtgttagccaggatggtcttgatctcctgacctcattatccacccagcttggcctcccaaagtgctgggattacaggcatgagccaccgtgcccagccggaaataattcttaaaagctgtttaaaggaggattctgatcagccaggttcagaaatcagtgtatcagatcagagaataagagtttgtccctgttctcctatggccacttaaatccagaccttttcatctgaaatgcaaatatgtttggcatttttcatacacattcctgtcttttttcccccttctgctgtcttatgtagatactgagaatattaaa

SEQ ID NO: 33577 - DNA, 356 bp, Homo sapiens
gcttaccaacaattcttctatttcatattaaagatacttcctgctaggtttagaataaaaataacttattcaattctgtccaaagaggattagttaatttttcaagggaattccttaagaagtgtagctatcttcattcaatgcttttaagcttagctatgataatagggggtcttgttccacttctgcttatcagtagaaattttctatttgtatgacatttccctagcagagcattgtgattgacactgcttgtaagacaagtaaaatgttagccgagcaatgtcagttgaaactctagaattcactgttgatctttttaaaataaataaactgacaatgacagcactttctca

SEQ ID NO: 33578 - DNA, 726 bp, Homo sapiens
agccaacaagtagcagagatgggattccagagacagaaatcttgctgttccttctattttattagaagtggtccagatatgaagatatatatatgctttttaaataagatttttgacaggataagatgtgtgataaggtgaaggcttaggaactacacagttaagctgtacaaagacacaaaatacctaagtagatgaaacatgaactttcctcccaaatcagaatgcagtctgtaataggtactttctgaataataagagttttagaaaagcagaaagtaacaacttttacaatagtatgttttacaataaaaatatagtttttcaatagttttacaataaaagtgtagttttacaataaaagtgttacttttattagtcacctttaaagagtgaatagtaaaagtgtatttcccgaagttacaaaggttaaaaatattaaaatggccgggcacggtggctcaagcctgtaatcccagcacttcaggaggccgaggtgggcggatcacgaggtcaggagcccgagaccagcctggccaatatggtgacactgcatctttattaaaaatacaaaaattagccaggcgtggtggcacatgcctgtagtcccggctacttgggaggctgaggcagaagaatcgcttgaacccaggaggcggaggttgcagtgagccaagatcatgccgctgcagtccagcctgggcaacagagcgagactccatctca

SEQ ID NO: 33579 - DNA, 463 bp, Homo sapiens
ttactttcagtttctgtcacataggtttgggattggcaggatagtttaatgtttaataagagtgtggcagataaacatgtctgccacctactagctttgtgactttgcacaaatcccttaacctccccgaaacctcagtttcttcttctgtaaaattgatataattataatacctacttcacaggattgttgtgaggattaaatgaaataatgtatgaaaagcataattttggccacacactgtaaaggaagagctcagtgtgcaagaatagttatgcttatttttgccatttttggatatttcagttctcattcatagcttcaccagaaagtgatcatggaaagagatacaacaacacatgggcattatgtatagataataaaatcagcgttataataatagaagtatttagaaagtaccagggaacacagggatgaaatccaccgatcttatttatgccct

SEQ ID NO: 33580 - DNA, 363 bp, Homo sapiens
ttctaacactgaagccaatttgtactacatccacatagtaatccaaaattgaattcagggctttaaaaatatccacagttcctgcttcaaacactacttctagaaatactaaaaaagtgatcctcaatatggaaagcatttatgcacaaaatacttatttatattatctaaaaaccagaaacacaccaaatgttcaaatacaggagaatggttaagttaatgacaatttattcactcaatgaaatactataaagccattaaaaatgatgctgtagaacactatttaatgatataaccaaatattcatgagatatggttctgttgggaagcaggatttggccaggtgcagcggcacactcctgt

SEQ ID NO: 33581 - DNA, 471 bp, Homo sapiens
cggatcagaggctgggggagccgacagtctgccttgcagtgaaggaggcatgtgatcaccatcaaagtcttctgctctgggaaggatcacacagtcgtccttcagcctgcctggggcgcagtgttttctttcctcagaccgaaactgcatgaagagagattccagcaaggaagatagagcatgccccgtacactcctctctggttttcttcctcaaaggaaatttatgcatgtaatccacaagccgaagaacccatgtttttctttggaaaaggctacgccctttcagggtttccttttctcggctgtgttgccttcccatcagaagctgtctcttgccctccccattatgggatgtgcgaaatgaaggaaaacagagacactgctgggcatttgtctccatgagttgatccaatcagaaatctttgacttttcagatatgtgtccaaaaatgagtgaaggctcctcacag

SEQ ID NO: 33582 - DNA, 489 bp, Homo sapiens
gaagcagatgtcagaaaagatgctatgctgctggccttgatcatggagggaggccatgagccaaggaatgcaggcagcctctagaagccaaaaaaggccagggaacggcttctcccctagagcctgcagggggaagcaggcctcccaccaccttgccttgcagcccagggagactgacttcagacttctgccctccagaactgtaagataataaacttgggttatttgtgctgacttgccacagcagcaatgagaaactaatacattcttcggtgccttgatgggccctggacttcatggttccggctgtgcttaggaccagtcaggaaaacagtgacctgggagggtcagtgaaacaaaccagcccaggtttcacagcaaggcagccctgaggaagagtgggccacaatccagccccaccagggcctggccttccagaaagccagctctgatcttgccgagagcattgcaggacgccagagcaggaag

SEQ ID NO: 33583 - DNA, 517 bp, Homo sapiens
caatagtaactcttatgctcaggtttttactatagggcaatggggcagttagactggacactatctgtgagtggggtcttgtgtccagattcacacaggagcccctatgttagagaagatttaactaatgcataaatatttgaaactgtattatcaactcagctcaggtagcagtttcctttttttattcagaatacttacacggagacacactgaagaacagacagacgtacacatcccccatgcacaccccacaaaactttctgatgtctagctaaaatgaaactaaagaccttggttgtttcaaatcaaggtctctggtagtaatttccagtaattgttttaaaatatctcttttaagtcaggagaactggggaagacctgttttgccctggctcatgcttttagcagttacatttctcagctttttattcagaaatatcttgattttcaatttccaaagtggagacttaggcttcaagaagtcttttcaggtggtacaagggcctggtagtat

SEQ ID NO: 33584 - DNA, 392 bp, Homo sapiens
acatttaggtggtttccacttcttgtgagttgtaaatagcaacgccgtcaacactcatgaactggtttttgagttcctgttttcagttcttttgggtacacgcctggggctggtggtgctgggtcatgtagtagttctgcgtttaatgctttggggacccccgtctgtgcgtctcaggtcacccacagcaccgtgtccatgcactccctgcctccgtgacacttgctggcctcaactgcagagtggacggttagcctgcgcgttaaacccacactcgccgagaggcgggagagtggacggttagcctgcgtgtttaacccacactcgccgagaggcgggagagtggacggttagcctgcgcgttaaacccacactcgccgagaggcgggcat

SEQ ID NO: 33585 - DNA, 403 bp, Homo sapiens
catctagagtttgaccatccttagaaatgactgtgggtagattcttattctcaagtgctagaggttcttgttctctttttacattggattttgatggtgaccaacatgactgtgaaaaggaattgtaccacatgaagagatacacttatagaattacaaattggtcagtgccccttttctagtattccagaattatctgactaaaatgattttgtttagttccattttctaaaagttaaaacacaaaatacaatggacgtaggcttctgaagtgttctgagtcacccacgtgaaaagtcatggctaagattgtttatgtccctggcacataatatgtcgtcagtaaagatttctagaatgaataaataacttttccaaataaatgctctgttttatcaattac

SEQ ID NO: 33586 - DNA, 575 bp, Homo sapiens
attttcttactgaactgtctctgacagtaccctgtggggatttgaagtgccacatcacagtctggtaggagtgggagtgttggctgcctaccttgcccttggctggtgtaggggagaagtggtgtcacagtgtcttccctgatatttaactggagtagagtggttacaatctaaaagtttgctgtttttttttttttttttcagctgcccctttaaagcaggcttttctttggggctttttgaattgcctgctttagcagcatgtatttcatgcctagaatatatgaggcaaaaaagaaaacccagaaaactcacctccatgttgttacttgagtcctgacatccctaggtagtctgtcttctttatgcctgtcagagtcaccttatgtttgctttgtatataatttccagagttcttaatatactcagtgggaggaacaaggaaaaatatgcctacttcatcttcccagaatcagaagtttcactcacaaaattttacctccaacctaaatcttttctccatggtccagaaatgagtaccctcattttaatctgcatttgtatgtctcaaagcc

SEQ ID NO: 33587 - DNA, 323 bp, Homo sapiens
ctcttctaaaaaatgattttattttaatttacagatacttgccagaactaatacagctgatgaaatacctgaccttttctgctccaggtaaataattttttactttataaaaatatcaggttctaggagaattcagagtttgtataaaaatacctatttaggcatgcaaagtaatataaatccagaccctaaagaaatgatccctttaataaataagttttattagtttataaaaaataatgacttatgttattgagtcaacttacagcagaatcaccttgagcattttattttattctattttattttattttttcgagaca

SEQ ID NO: 33588 - DNA, 522 bp, Homo sapiens
tttttatccatcatctttaataatttggtgtagacatgtaaaatgtgttttacctaagaagatgagagttgaaatactgagttgaatgtgtatgtctatcttcctggtaatgcagggagtaggaagaatagacaggatgactaggggaggatgtcacatatctgaattaaagtagtagtacctttctgcttaatagttagaaatgagattataaaacactgacattgatttttcttgtgactgattaaatgagtcacactagtttatattcatatcatatatgtatagcattccagagtaaaactcttagacatgtttcaaaggggagtggaacatttgttaaaatcctggttcctcactgggaagttggaaaggccagaattggagctaacagtgaatctaagaggtagaactagaccgggaaccaagtgtcaagttgattgtaagaactgacagcagtggtcaggcagaggggtaggtcaggtacaggagatgcttggaggccggtggtgaaaaaaaaaa

SEQ ID NO: 33589 - DNA, 808 bp, Homo sapiens
aggttggtaagtatccctagtcttcccccaataccagcagcatccccgcccccacctagcattgtcacagccagaagaaatagccctcacaaacttccatagggccataccatccccactgagaaccactgatctaaatcaaattttgtaaacttaggtaaacttagttttgggtaaaacacaatctctgtaataaagcaatctgacaagtaaagtccttatctctttacaacgaatggagagaaaggctagagagaaattctgtcatggaaactagagtaccgtcaaatttacttatgagaccttttcctaagttaattgtatcaatttacctgtggtttactaggtcactgtagcaggtttattaatggcctccaaagatattaggtcctaatccctggaacttctgaatgttactttatgtggcaaagtctctgaagatgtgattaaatcaatggcccttgctaagaagagattatcctggattactctggtggtgttaaatgcaatcacatgcatccttgtaagagggaggcagaaggagatttgacacaaatacatggaggaaaaggccatgggaagacagagcagactgagtggatggtgctggccttgaagattggagtgagattcggccacaagccaaggaatgccagcggccacacaaagctggaagaggccaggaagggatgtttccctatagtttctggaggaagcaagctcttgtccacaccttgatttcagcccagtgatactaagtttgtacttctggcctccagaactgtgagaataaatttttgttgtttta

SEQ ID NO: 33590 - DNA, 373 bp, Homo sapiens
ccgcgtcgactgaaaacctgttataggttttgccccattcttcacacttgtaggatttctgtccagtatgaattctgtataataagggttgagaacttcctaaaagttttgtcacattctttatatttgtagggtttatgttccatataaattctcatatttagtaaaagttgatagctggttaaaggctttcccacattcatcaaactcatagggtttctctccagtatgaactatcttatgtctggtaagtgtagaggagtgcttaaaggctttgcacattttcacatttgtatggtttctctcccatatgaattatctcatgtctactaaggtttgaggatgaaataaaggccttgccacatttatcgca

SEQ ID NO: 33591 - DNA, 1014 bp, Homo sapiens
aaaaaaggagaaagagctacaggagagatggaggaagagacaggatttaaaccatgtatgcctttgtccttgcaatcttagttctattttatgttgatatctcctacagctaattatgttacttctgtttcacatggatctcatatagaaaatgcacaagtgtttaagaacagaatataatgatgaaggaatatcaataagtatattttttgcattggttatattagtcaaacatggcattacaaaaggagtgtctaatcttccccagatgtcattataaggtaaagttcttacatattattatcagcatcagtaaaatttgataaatttctatttgactgacagaaatacagatttatctttgttccatgccactcctgatagacatttacctccaccttggaagaatacaaaggactccacttaaaaggcaaatcaagccaaaccttataaagacaagccacagacttcaggttacatgttttgagttctgcacaaaatatttgaatgggtgcttcataaaagatgatatatgaggacttggggcagaacaagatggcagaatagaaggctccgccaattgtccctgcttcaaggacaccaatttaacaactaactacataaaatagcacctttataagaaccaaaaatcaggtgagtacctggctttaacttcgtattactaaaagagggcactgaagagtgcaggaaaaaccgtcttgaattgctgacatcacacctcctctctcccgcagcagcagtggcatggtgcagagaacatttttgtgtgctggggagaaggagatcacagtatttgtgaggcattgaactcagtgctgccttattataacagaaaacaaaattggaccaatctattcatgaattggaaaaatcaatattgctaaaatgtccatactacccaaagcaatctacagatttaatgcaatccctatcaaaatgccaatgacattattcacagaaatagaaaaacactctaaaacgtatgtggaacca

SEQ ID NO: 33592 - DNA, 721 bp, Homo sapiens
caccaaaggcgtatcctagctttattaaagggcccgcgccacggagtcaatataaaaacacaaaaagtcccatcagtttaataacaataaaaaaacccaaaagtggaaaactgagggggcaggggaagagacccctgggccaggggcaccgaggagccctgctcatggcaccaggcctggccgcagggtcccccggtattgctgttgctacgaggttggggggcagcgattgtcctgtgggaaccaccgttctcctgggtcggggaccctcacttcttctggggtgtgctcagcttctgcatgccccggatcttgtccagcagaccagaaatgaaggcctctgtgggtttgtaacagtcaaccagcagctccttgaccgtggcagcccgggcatcgtcactctccatgtccaggagctcatccacgtcaatctccagttctgggatctcctcttcctggcagtcgtagaggcgcgtgagctgctccaggatccactcctctaggttgaggcgcttccgtagctccttgcggtcatacttgacggtgaccttcccttggcgcctcactgggccctcatcgtccgccccgcccgggccctctcctgcggccccgggggggctctgaaagtagacgcgtggtcctgggccgccactgcccggcccgggggccggggccgccaacgccgcgccccccgcggtgccgctgtccgccatggcggccg

SEQ ID NO: 33593 - DNA, 516 bp, Homo sapiens
  misc_feature (23)..(23): n is a, c, g, or t
tctggaggacactaggcttgacntggggagtggcatgatggggggcagggtccgaggcaacggagaaggcagaagtgacttaggtcaggcaagaaagagtatatattgggggcgggagtgcagaggggaggggagcgcgcggggaagcaaagcgccctttgactccagtgacaggcgagctcacagtggagctgccaggcggaccggcgcgagaccgattttggggtgtcggcgcggggtgggaacacacctggcagtcgtagaggcgcgtgagctgctccaggatccactcctctaggttgaggcgcttccgtagctccttgcggtcatacttgacggtgaccttcccttggcgcctcactgggccctcatcgtccgccccgcccgggccctctcctgcggccccgggggggctctgaaagtagacgcgtggtcctgggccgccactgcccggcccgggggccggggccgccaacgccgcgccccccgcggtgccgctgtccgccatggcggccg

SEQ ID NO: 33594 - DNA, 342 bp, Homo sapiens
taacttttctgcagaagttattattggtgttatactcaaaaataaagcacagtttagccctggcctgtgcatttacaccactgaataaattaccaaaagtgtctgtctagcaagagttcgttctaacaaagtggagaggaagagccagttttatacaaatattgaatcatcccacaactacatttcatgaaactccctgattttttttaaaaagagactcttgctctgtagcccaggctgcaaagctggagtgcagtggcctgacctctcagctcactgcaacctctgtatcccctcagcctcctgagtagctaggactacaggcacaggccactgcccccc

SEQ ID NO: 33595 - DNA, 298 bp, Homo sapiens
tgaagagttgctgaggcagaactgaaatcatggctcacctcaaagaagcagcagtattggccgttaatgatgcctcacacagaaagacgatgctcctttaactcggggttttaatgggaagtttctaagcctgaaacaacagctttagacctggggtgtgccatcagctgccttgcagctaccactgtctactgctttcacacagcgtggtcgggaagaatggaaactaaagaggcttgtaactacctgtaactgttccaccaggaaatggatcaagtgtttgttcagccagagccag

SEQ ID NO: 33596 - DNA, 540 bp, Homo sapiens
ttttatttttatgggcaatataatctcaaatctgaaactactacttaagagtttttttaaaattatcttcaggatcaatttgtgtattagtttacttttgtttatctttttcatgctatagattttctcttcaaatgtctaatgacacttgatcgtcccttccttgagggatgaatggggaatgggagggtttcctgggaacttaggacacatggggctagcagcaagaagatctgatgggacatgctgactgaacatgaggggtgaggaagatgcaggggcctagagtaatcttcagactcctagatttttgacttgtaacatggtagggatgatattttcagttactgcaatagaaaatacagaaagataaataggtacattagaagaccaaaaaagaagagctaaggaaacaagttcacttttagaaatgtatgagaactagtggtactggagtagaggattccaggaagcaggtttggagttcataagagagcccatgcctgacctctcaaatctttaagagtaaaaacagtaata

SEQ ID NO: 33597 - DNA, 219 bp, Homo sapiens
cctcaccagctctggggagttcagggaaggcttcccagcagaggtggtgtttaagtggagacctaaaagtattgagggaatgcacaagaaagagagaaataaagacaaaatggaaagggaggacaaaaagagggaaaagagaaaaaagagcaaaagaaagacacacaccgggcaggcacagtggctcacgcctgtaatcctggcactttgggaggccaa

SEQ ID NO: 33598 - DNA, 367 bp, Homo sapiens
acaaaggcctcagaggtgctcattgtccacctgcaggagtgtgcccacagagcttcaagaagatggttctcactcctctcgccctttgccctcattgagaaagctacccacagctatacactgggacggagaaggaagctggctacaagatggggcaagcatgtctgtcactcaaacgctggccttcctggcctagtcacccatttggcacattttcccggatgcccgtgatagtggcattgtgctgtggcattggcctctgctctgtcctccctcttgttctgtctgcccagttcctgtgaagcctagaggcttcttagtctggctcaatgtcttcaacaaagaacacttctcagtccattaggaa

SEQ ID NO: 33599 - DNA, 500 bp, Homo sapiens
catgggatctttagacaaagagctgaattgaattcgtaagaaagagctgcgaggcgcaatggctcgcacctgtaatcccagcactttgggaggccgagtcgggtggatcacgagtcaggagattgagaccatcctggctaacatggtgaaaccctgtctctactaaaaatacaaaaattagccaggcatggtgatgggcgcctgtaatcccagctactcaggaggctgaggcaggagaatcgcttgaacccgggaggcggaggttgcagtgagccgatattgcaccactgcactccagcctgggtgacagagcgagactccgtctcaaaataaaaaataaaaaaagagaaagctagatcatatcttgggataaatgttaataacaaatatcaggaataacatttgtcctttatgtaccttttttccagtggacacagtgggatttttttttttttttttaagagattggggtctgtatgtttcccaggctggtcttgaac

SEQ ID NO: 33600 - DNA, 491 bp, Homo sapiens
ccagaatcaagcagaaagcagacagccaggctttagaaccaaggcctactagtagatactaggaagtggttgtgttgcttcaattagaggggcacaatttcaaattacccttaaaaaaagtcttgaagaaaaatattgttaagtatcactttcacatttctgagtcattttttcagaactgaagagcctgtgaaacagagaaagattgctctagagccacacaataggaactgggtacatggaaatacaccaggagacatgtcaaactatagaatggacttggcacataaccctggagcatgattttacttgaagtcaatgtcaaaataaatactaatttttatagtgtagaatgtaaaacttacactaactttttaggaaaaaaaaactgttattgttatggggttactttaaaccaagtcccctggatttctatttagacatggcttttttctcacccctgtgagtaaaagcttctcaaaggtcttggg

SEQ ID NO: 33601 - DNA, 416 bp, Homo sapiens
tcttttacatgctttaaataccttaaagtaggcagaatctcaaatagtgcaaggatgcgtattgccctatggcaacagtgagtggcgacagtgagctgttatggagctgtccagacttttcctccctccagtgagtgccagctgtccttgcatggagtcctggttcctttggtggagaatggtgttgaaaatctcagcctttgcggcggagagcggggacatgggacacaggggagttggtggtgggcagagatgctgctgggccactttcagtgacaaaacatgacagcaaaggctcttgaagtcagtgcagacaccttcagggatacaaccccttcgaccagggctgtgccagcaactggtatttaacaatttgtgcaccactgggacccaagtgagttggcaagccagaggcc

SEQ ID NO: 33602 - DNA, 449 bp, Homo sapiens
ttcctctggggcttgtctggcattttcctagccagatgttcttgcatcctagtggtttcctgttaggaactcagggctgtctctgctgctaaatgcagtttcctcaaggtctaccacttagaaaagtcatttgtttcacttgcttactttccttccttcagggtcctgcaccacatcccctgcacccagtgggtgacgcagaaatgcccctgggagtaaaatcccaattcttggcttaagcctgttttagtcagaaaccacccaatttagcgtgcaggtcaccagagtgggtagagggtcagaggtcaggtctttggccctgagaaatgaaaatgcaggggccgtgctgtcccttgtacctcaggagagcaaggaagaaactgggccttccctggcagggcttcctgctcctgcttctgtctccactaggctttcccagaaggcagcac

SEQ ID NO: 33603 - DNA, 367 bp, Homo sapiens
tgaaacagaatggggggagaggactggaggtacaagtggggtctccactttccacagacatagcttggtttaactctcatcttttcagtgtggcaccctgccttcgatcatgcctgccaggctcctcctggtccacaagcctttttccctgtccagataataagcttagttgccttcctcagtaggaaaggagaggttttcctacaagtatggagtaggaaagaggaactaggaatcttaacacttcttaaccaactctcaacccttccttcttattgggaaagcctcacttctgggaaattcctgaaccgaataccctcctcccaatttccagagtcttaaggattttctcatgtaaaccaggttg

SEQ ID NO: 33604 - DNA, 442 bp, Homo sapiens
caagtcagaatccatcgtgtgtggggtaaatgagtggttagaccatggggtacatggtgtaagggagatgatgccagagacatagctaggaccagactgagaagcaagggactcgaagaccaggccatgcagcttggacttgatcctggacatagggaaagtgatgtgattagaggatgtgggggttctgggctcaagcatcctcgaagggtcgcactaagggcaaggctccccctccccacggcagttggcaagcagcggcttgctgtttgagaaggtgtttactcctctggagcatgagtcccacactcagaaggtgctgagactctgctcgtagggtaagcatatgaagggccggtcccagccaggacagctgggagtgcgcagtcagcaaggcaaagcaccaggcttatgtcttccctcttcttccatccttcttggc

SEQ ID NO: 33605 - DNA, 473 bp, Homo sapiens
  misc_feature (286)..(286): n is a, c, g, or t
  misc_feature (345)..(345): n is a, c, g, or t
  misc_feature (383)..(383): n is a, c, g, or t
  misc_feature (470)..(472): n is a, c, g, or t
acactgcctcctagtcccatgatgaacgatccacaggaagactgaagagaggtctccatagagagtgctatggaagtgatggctcctaagagtcaggatttcgtcaggaaacacgtgggcaagttcagctgagagactgaaatgtagaaaagggtactgctagggatgtggcattcctggtgggaatgatgggaaaagacgagtaaacaggagcgcagagagtctagagatgagagtgtgtgagatatgactgttagctatttgagcaattccctagagtatttgnacatcaagatgtttccagaaatgtactgcacttctccttggttagcttttttaactacnaaatcatctcgtatgtggtggtgaaaaacaaacaaacnaaaaatctgctaccttaagtacttaagtggcctcgtgtaggaatataagctctgtcatctactcatagagcctcttactcaggccgnnng

SEQ ID NO: 33606 - DNA, 186 bp, Homo sapiens
tttaagaagccttttccagaagacaaagggtgggggatttcttcacctagtgctattttccaaaatacttggctcaggtaaagctcaacattaccataaacagaacaaactatatatatatatatgtatggtttgtatatgtttaagtacgtatatacagtttcgtttacatgcatatgctgaata

SEQ ID NO: 33607 - DNA, 284 bp, Homo sapiens
ggagaaattcagaaacagctaaattattaatacttggaagctgatggaatgaatcaatatggcatggcaaaagaatctcgcagttgccatttccatatttcctgagtttaagacatgctgattagatgctcttagcacatccattttgaaaaacagcacatattttaaagacatatggcatttagaaatgtcacaataaatgaaacagtagcttaattgtttagggtaaacatttattttacagctagataactttgtaaaattatataatttaactcaatgtt

SEQ ID NO: 33608 - DNA, 417 bp, Homo sapiens
aagtgtctgtcagggccaattgtgggccagatgtgcccagggttctatagctagctggtggaaaggcctgaagggttcatattcaggtccacttgacttgaaaactcatattgaccttacttatgtactaattcccactttacaatccatgccacaaactttattgtcttaagaagttgccacagcagccttcagcagccaccttgtgatcagtcagcagtcatcaacattgaggcaagaccctactccagcaaaaacattagtattagctgaagcctcagatgactgttagcattttttagcagtagtgtaatttttaattaaggtatgtacatatctattttatacataatgctattgtatacttaataggctaaagtataaatataacttttatgtacactacaaaaacaaaaa

SEQ ID NO: 33609 - DNA, 380 bp, Homo sapiens
tggatagtatcagctttgaacatgatgttcatttatcttctgtgttggaatcctctactgacttctgaacctagaacatattgacatcaatataactatcactaattctgtgaaattttattttatttaaaataataaaaaagtaatattagacttaatacaaactctaattactaagagaagaatgtgaagattttagcccaaggaatgagcactcccataattaactcttactgctgcataatgtatagttaaacaaagggtgacagttttagctggaacattaaatgtccaccagttgtgaatgctacagataggaaatttctgtaatgggtggcaacttggacttgattacctcagaaggaccttccaggtaaaaa

SEQ ID NO: 33610 - DNA, 299 bp, Homo sapiens
tttaattgactcacaattcggcacggctgggaggcctcaggaaacttataatcatggtggaaggtgaagggcaccttcttcacaaggcggcaggaggaagtgagtgcaagcacaggaaaaacttccacttttaaaaccataagctctcatgaaaactaactatcgtgagaacagcatgggggaaaccgcccccataatccaatcacttcccatcaggttcctcccttgacatatggggactacaattcaagatgagatttgggtggggacagaaagccaaaccatatcaatactattgt

SEQ ID NO: 33611 - DNA, 492 bp, Homo sapiens
cacagataaccactaagacctatttaaatatgtatctcatggctgactggcagctccatacccaaagctactgttacaatccaggctctcatcttacctctggtcctgctgtttaccctacaactaccataatgtttaaatagcagaaattattagattcatcagtgttgttttaagcaggtcatcattttgatttattttttattttttctgttctcagagtctgttcccgtaggtcattatttctttatttatttatttatttatttatttatttatttagagatagagtctcactgtcgcccagattggagtgcagtggtacgatcttagctcactgcagcatcaaccttctgggctcgtgtgatcctcccacctcagcctcctcagtaggtgggaccacagttgtgtgccaccacacctggctaattttttgtatttttttgtagagacaggaatttgccgtgttacccaggctggtctcgaactcct

SEQ ID NO: 33612 - DNA, 541 bp, Homo sapiens
ggctcccgcccccagacattctgatttaattggcatggggcaagacctggacttgggattttttttaatgctcttcatgtgatctgttgggcagccagatttggggatcactagacggaagaaggattgttaaagtctccggagatgttacttgccaatgctaagagctctttgaggacatctggaattgttacaatattgccaaatataggaaagagggaaaaggtagagtgtgattccaataataaaggattccgcttttcattgaaggaactggtggaaaggtttcttctctgctgagcctgcaggcccgtcctgcctgcctggggtgcccgggagacgcgggcctgctccggagactgctgactgccggtcctgttagtcaggtgtcagccctgtctctgccgaagagactcttctctttattttaaattaaaccctcagagcaccaccaaagcatcacttttctccctccattggtgttctcattctttgatgttacttgtttgaacaccactattagtagttggagatttgttcc

SEQ ID NO: 33613 - DNA, 1525 bp, Homo sapiens
gttataacttcaacatgaattttttggaggaaacaattcaactcctaacacatctctacccaacctctgtaggttccctcaatccaccaaaattttttggctccactggattatctagcagttaggaaaccaagatcattaaatgaattcaccgcaactacagtgagactgactaccttagcttacctctgtgaaaggagttaagccaaaggaatctgtggaattttggagagtttgggagcatttgggggcaggaggcaaatgttcttcctttaaatcacaacacttagttctcttccatttataagactcacccctccatcccaacccctgcaccacaggacaaggaagtgttcttggtcttcaactttcatccctgatggtgaaagcagttgctcctgacctatttgcccaccagcttctcctctggagcctgaggcttctgatgcctttcagtacttaaatatgagttcagaccctggggcctggacataagatttggggtcccctggatataagatttctgaaaacactcagactgtggagacccctgctgagggagaagccccaaactgtggcttcaggggaatgcaccaaggctctcattgaggccaccttctccaacaagctcccctcctgcttccccatggctggcatggctgaggaaaaaggacactgagcacagcccgtgcatgagcggcttgccatgcaacaggataaaacccataatgccactcagcaagccttggttgtaaatctagtttgattacatttgtaatcaaatgatggccatttgttctgtttctggtttgtgaaccaactgaagacataagcagggcctcagctaacccacaaatagcacatgtgtgcaaactggaaaaatgaacccttcttctgggaggacgccagcccaggccaggtcacccggcttggccagcagaacacagagtagattttggtcccgtttgttccccagtggggtatctatccttgtgcagggcacaagcctacatggtggctctggtcatatcattagaaaatagacagaaatgggctgcacaccagaatgaatgaattgaattgaaagggaggagtgatggtggaaaaaaaaacaagtcaattcatttagactggtagaaccagaaccactgtgtagtacatccaaacggttaaaattccctggaagatgttacataatcctatcatggtgtttatttatggaaatctattttaaaaattttatgtaatactgcacagtctgtttgcatgatgccttgtacgtagtagcaactcagtaaatactttttgaatgaactagtatagtattttaattagctagtcttcatgtactggtacaaaagaacagtgtcatcttacagctgaagtcatagaggggaaatatcccactcaagatcatataacattccaggtactcaggatgaatggtttgaggactggtctgaattcttcaaaggtttcagctgtattaacattctccatctaataaactttatcttgtcattgc

SEQ ID NO: 33614 - DNA, 1583 bp, Homo sapiens
gttataacttcaacatgaattttttggaggaaacaattcaactcctaacacatctctacccaacctctgtaggttccctcaatccaccaaaattttttggctccactggattatctagcagttaggaaaccaagatcattaaatgaattcaccgcaactacagtgagactgactaccttagcttacctctgtgaaaggagttaagccaaaggaatctgtggaattttggagagtttgggagcatttgggggcaggaggcaaatgttcttcctttaaatcacaacacttagttctcttccatttataagactcacccctccatcccaacccctgcaccacaggacaaggaagtgttcttggtcttcaactttcatccctgatggtgaaagcagttgctcctgacctatttgcccaccagcttctcctctggagcctgaggcttctgatgcctgcctggctggttctcagtaagaaggtcaagttcaaccagaggggagatgctgatgcctttcagtacttaaatatgagttcagaccctggggcctggacataagatttggggtcccctggatataagatttctgaaaacactcagactgtggagacccctgctgagggagaagccccaaactgtggcttcaggggaatgcaccaaggctctcattgaggccaccttctccaacaagctcccctcctgcttccccatggctggcatggctgaggaaaaaggacactgagcacagcccgtgcatgagcggcttgccatgcaacaggataaaacccataatgccactcagcaagccttggttgtaaatctagtttgattacatttgtaatcaaatgatggccatttgttctgtttctggtttgtgaaccaactgaagacataagcagggcctcagctaacccacaaatagcacatgtgtgcaaactggaaaaatgaacccttcttctgggaggacgccagcccaggccaggtcacccggcttggccagcagaacacagagtagattttggtcccgtttgttccccagtggggtatctatccttgtgcagggcacaagcctacatggtggctctggtcatatcattagaaaatagacagaaatgggctgcacaccagaatgaatgaattgaattgaaagggaggagtgatggtggaaaaaaaaacaagtcaattcatttagactggtagaaccagaaccactgtgtagtacatccaaacggttaaaattccctggaagatgttacataatcctatcatggtgtttatttatggaaatctattttaaaaattttatgtaatactgcacagtctgtttgcatgatgccttgtacgtagtagcaactcagtaaatactttttgaatgaactagtatagtattttaattagctagtcttcatgtactggtacaaaagaacagtgtcatcttacagctgaagtcatagaggggaaatatcccactcaagatcatataacattccaggtactcaggatgaatggtttgaggactggtctgaattcttcaaaggtttcagctgtattaacattctccatctaataaactttatcttgtcattgc

SEQ ID NO: 33615 - DNA, 789 bp, Homo sapiens
gggtctctctctctctggagagtggctgcaaattctagccctacccagaccgggaggagagttacattccagtgtgttgggcgggcaagatgtagaggaggcagcacaacaaaacacatgaaatgtcagaagcatcctcctactcacagatccccaggatgggaggctgctctcgggggctgatggaagtccagagacagccgggtgttcaacctgtgggataggaatgagagaggacctgttgggccttgcgttattaaggtgcatggacgttatccctcaggacttcctttgggggttgtggattggttgcgcaaaggaaagttcttatttatatgactctggtgttggccactaagtttcactgtagtcagcagctgtgagatgtgttggatttggggccagtgaggtgaggaacaagcaggctgtataacaaacagctacacaggcaggggaagttttaactaagacaaagacgatgggggtattggagctgagataaataaacagctaactggcatatttcacttttggttctttaccatccatatgcactctcctacacacataggaatttctttggaataattaaacaagtctatattcctacctaagaagatatgagggaagaagtcctcacccacccccaaaggagcagatgcgcagttcaaacagtcctttgtattcccatggcacgccatgtcaattactcctcaaatttagtcccattctaactattctgtttcttaaagacaaaattataaatgtaacctctaataatgtgtatat

SEQ ID NO: 33616 - DNA, 249 bp, Homo sapiens
ttgcagatgatagaataaaaacatgtgtagaatatgtccaaggtcacacaaagagtgagtggtacagctgagttgaaccccaataagcctgactcataagcctggctgagtcatgctgcttctcagaactcttgatccagtacttttccccataagctgtaactccttcctgcagtgtatgattgccacagtcatattattgagaagtgacccctgtgtcacatcatcagtgcacgttgtattttttgt

SEQ ID NO: 33617 - DNA, 342 bp, Homo sapiens
  misc_feature (331)..(331): n is a, c, g, or t
ctgccgaggctggggtgcagtagcacaatctcagctcactgtagctagcctcaaactcgaccttctgagctcaagtagtccctgcacctcagtcccccagccccaagtagctgagactacaggcacatccccactatgcccggctaagttttgtattttttgtagacagggtttcgccatgttgcccacgctgcccatgctcgtctcaaactcctgagctcaagtgatctgcccaccttcacggcctgtaaattcccagcattttggggagggttgagacggggaggattcgctttgagcccagggagtttcgaaggttgttcgtggaggntgagattcatg

SEQ ID NO: 33618 - DNA, 484 bp, Homo sapiens
gggttttcatggaagctttgtgacatcagcattccttcccccagggtatacagcaggaacctctctggggaggtcttaagacccgcaatcagaaaggtagggggaaagttagagtcctgccttagggcaggtgaaagaagaggaggagaaggttggagaggttatttttcttaaggtctgcagagaaggtctaacccaacattatacccaaagactgtagcaagggctatgggagttatgagccaggaactgtggacaaaaaccaaggtatatgtgtatcataacaccacacagaggagcctggaacgtgtcctccctggataccaagggagggattctgaatcgaaataatggatgtgcacccagtcagtaatcaatgaaagagagttaataagcacaagtgggtaccactgcatttaaatgatataagaccagagagtcaagaaagacctggatcccggaagagctcaattaaaaaaaaaaa

SEQ ID NO: 33619 - DNA, 2054 bp, Homo sapiens
catcaccctttttaacattgtttacacatcactgcctgttttagccatggggatttttgaccaggatgtgagtgaccagaacagcgtggactgtccccagctctacaaaccaggacagctgaatctgctttttaacaagcgtaaattttccatttgcgtgttgcatggaatctacacctcattagtccttttcttcatcccctatggggccttttacaacgtggctggagaagatgggcaacatattgctgactaccagtcctttgcagttaccatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggcttccaagcctgaagaatacaaaagtgtgcttgtgtttctcatttttataccagtctagggacaaaggagactgaacatctttgcagcaggataggctggtaatttgatcaaatttattcaaaaagctctcagtctgtgtcatgtaaggacatgcttatgaaatgtgagagaggctcgccactaagtattctaaatacttttcaatggcttttctaacaacctcagtagtaatttgctgagcatcatccagaccattaatagaatcagcaaagcactggaatttcacactttaatgataatattccacatagtctatgggcaaatattttcaacatttccaatttttaaagcttcagaattgaagccaaacaaattaataaataattgttttaattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatg

SEQ ID NO: 33620 - DNA, 2200 bp, Homo sapiens
gtaaaaaagatcatgcatgtgtaaaaatggtattgtgaaaatttacttacagagtataaaatgttgcacttgcccattacagaaagaatttttttccaatagaaaagttttgagagacatttgtaaagtaacttaaaaattataagcccttgtgctttcatatttctcacttaaaagaagtttaacatgtttaacatcttacctcctgattctgactcgaccttggcagatataatggcttgcgtatagaagttctaaagtcaattttctaccagaaatatgaagtcagatcagtcccctgtgtgtgttcagaaagtggggatgcccgcggttggcttggcaactaggcaggtgcaaacttcctgccacagggcagttctcgcgaaacatcacgaggtaaaatgatgctgttttaatcctcaaagacctcccgtttgcatttgattttatttacagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggcttccaagcctgaagaatacaaaagtgtgcttgtgtttctcatttttataccagtctagggacaaaggagactgaacatctttgcagcaggataggctggtaatttgatcaaatttattcaaaaagctctcagtctgtgtcatgtaaggacatgcttatgaaatgtgagagaggctcgccactaagtattctaaatacttttcaatggcttttctaacaacctcagtagtaatttgctgagcatcatccagaccattaatagaatcagcaaagcactggaatttcacactttaatgataatattccacatagtctatgggcaaatattttcaacatttccaatttttaaagcttcagaattgaagccaaacaaattaataaataattgttttaattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatg

SEQ ID NO: 33621 - DNA, 2231 bp, Homo sapiens
gtaaaaaagatcatgcatgtgtaaaaatggtattgtgaaaatttacttacagagtataaaatgttgcacttgcccattacagaaagaatttttttccaatagaaaagttttgagagacatttgtaaagtaacttaaaaattataagcccttgtgctttcatatttctcacttaaaagaagtttaacatgtttaacatcttacctcctgattctgactcgaccttggcagatataatggcttgcgtatagaagttctaaagtcaattttctaccagaaatatgaagtcagatcagtcccctgtgtgtgttcagaaagtggggatgcccgcggttggcttggcaactaggcaggtgcaaacttcctgccacagggcagttctcgcgaaacatcacgaggtaaaatgatgctgttttaatcctcaaagacctcccgtttgcatttgattttatttacagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggcttccaagcctgaagaatacaaaagtgtgcttgtgtttctcatttttataccagtctagggacaaaggagactgaacatctttgcagcaggataggctggtaatttgatcaaatttattcaaaaagctctcagtctgtgtcatgtaaggacatgcttatgaaatgtgagagaggctcgccactaagtattctaaatacttttcaatggcttttctaacaacctcagtagtaatttgctgagcatcatccagaccattaatagaatcagcaaagcactggaatttcacactttaatgataatattccacatagtctatgggcaaatattttcaacatttccaatttttaaagcttcagaattgaagccaaacaaattaataaataattgttttaattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatgtgccttctctgagactcagtttcttcctctg

SEQ ID NO: 33622 - DNA, 2177 bp, Homo sapiens
gtaaaaaagatcatgcatgtgtaaaaatggtattgtgaaaatttacttacagagtataaaatgttgcacttgcccattacagaaagaatttttttccaatagaaaagttttgagagacatttgtaaagtaacttaaaaattataagcccttgtgctttcatatttctcacttaaaagaagtttaacatgtttaacatcttacctcctgattctgactcgaccttggcagatataatggcttgcgtatagaagttctaaagtcaattttctaccagaaatatgaagtcagatcagtcccctgtgtgtgttcagaaagtggggatgcccgcggttggcttggcaactaggcaggtgcaaacttcctgccacagggcagttctcgcgaaacatcacgaggtaaaatgatgctgttttaatcctcaaagacctcccgtttgcatttgattttatttacagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggcttccaagcctgaagaatacaaaagtgtgcttgtgtttctcatttttataccagtctagggacaaaggagactgaacatctttgcagcaggataggctggtaatttgatcaaatttattcatcgccactaagtattctaaatacttttcaatggcttttctaacaacctcagtagtaatttgctgagcatcatccagaccattaatagaatcagcaaagcactggaatttcacactttaatgataatattccacatagtctatgggcaaatattttcaacatttccaatttttaaagcttcagaattgaagccaaacaaattaataaataattgttttaattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatgtgccttctctgagactcagtttcttcctctg

SEQ ID NO: 33623 - DNA, 585 bp, Homo sapiens
catcaccctttttaacattgtttacacatcactgcctgttttagccatggggatttttgaccaggatgtgagtgaccagaacagcgtggactgtccccagctctacaaaccaggacagctgaatctgctttttaacaagcgtaaattttccatttgcgtgttgcatggaatctacacctcattagtccttttcttcatcccctatggggccttttacaacgtggctggagaagatgggcaacatattgctgactaccagtcctttgcagttaccatggccacatctttggtcattgtggtcagtgtgcaggtaacgctgtcggtgtaagcaccttaacttgatgggtttacaacttttactatttcattgttgattgattttgtctacttgttggggggaaataatcctaaaggaatactggggctgtccttttaagtacacattttgagatgaaagcaggaagctttaacataaattactggggagaattagcattaggcgtctgtaacattcatgttagtagaaacctcacaatgtatcacttctttgggttgtgcattgtatgtaaagagaaatgattatac

SEQ ID NO: 33624 - DNA, 484 bp, Homo sapiens
caggaagggtatacatcactttagagataaagaaactgccgtttagagagatctagtatcccattaaggcaccagagctgataagaggcaggtctaggaaagaattcatatttgtctgattccaaaagtcaactcccacccacctcagaaaacctggttatttaacctaaatgtgaatattctcactactatggatgatgtttctcacttatatgttatatttcttttcagactgtttatgaccagtggttcatcaccctttttaacattgtttacacatcactgcctgttttagccatggggatttttgaccaggtatgttttttttccatctttataacttagtttctcttttatgccttttagttttttgtgggttctaagtagaaaacacaattctaagtagcagccctaggaatgcagttgttttagttgcttttgcatggatcacacatgcttccaggtccactgtgcctcccttacc

SEQ ID NO: 33625 - DNA, 297 bp, Homo sapiens
ttttctttttgtaggtgtgtgtgcctcatctctgccctccatacctaagctgcctagaatcacatccagactttgggagcttttgggtcccatgtagtctcttgaaggaaaatgaggctgtgtggacagaatgtggtgttgctgtgtggggtgatggacaaggaactggactgggagccaaaagctcacctttctagtcctgtcaatcacacaattaaatgtggaagtagaagtggaagcactacaaaaatgattatacatgtcaagtggcaataataatttcatgctgtgactgtc

SEQ ID NO: 33626 - DNA, 2336 bp, Homo sapiens
cttttaatttttattttggcaaaactgtcaaatgagaaaaatgattttaaaaacttttttttcaattgacaagactttaagtcagggataacagtattaatgttctctgttctgtttccatgttaaatttaatttaacctggatagccacattaatgaattggtgctgtcaaaatatagtaatttttaaatttgttaataatgaaaacccttaagcatgcaggatgaggtatttgggttttttttttagatcgatcacatctacagaaaatggctaaaccaagttaacttttattatagacagtgaataaaacaccaaaaacccaaaaatgctttaaccacagtataaataatagattatacacatcatcttaataactatttttaagttatttaccatagcctctgtatagaccttaggaacagtgtttcagtgatctggcaccagtttatttggttctgctgacaattctgtatcacaaatgtgctacctggtttttgtccattagataattactctttataaggaaaggaaagagaagcagagttagttccagctctaatagggatcttcaaagttattttgtcttgatgtatgtaacagtaattctttacatcttttgatttttctcttcctttttattcactcttcccacgaatttaaatgtttaagttatattcatcactagcaaggatgataaacacttgtgcactgaaagctaacagggagaggttacacaatattttacagtttcttaaacataatttaatgcatcaccttccacttgctaacataccaagtcagttattttcaagggaagaaccttttaaattatggtcctccatttactacttccactgagagtatgctctcattcctcaggtgttttgagaaacatgactaataaccacacaattaagtagagtcattccaagtcctatggcctggaaattgtattccctataatatacaaattttcctgtaataaagtcaacttagaaactccaaggaggttacatgttttccaacatatcctaaaaactgtgatataagctaacatataatttgccttacgtcaaaagaatatgttttgttgcagctgattccagtttataatagatccctagtaaaaagctttgattcaacacaattgttcatcttcacatcccaaacagaatcactgtttcttgaatatatatttttgaagtttttttgtgcaatatattactaaatcagttattattttacttttccaaattcagagaaagaaaacagattacctgaattcatggaaaaggtggatcacctccctttttccaccttcaagcctttcctgtcctcatagccagcatgacttcttttaacttggattcctttgtatatagtaaagtttagtatatatatatttttttctttttgctactttctgaggcattatgtaaagggctcatactagatgttcagttaaatatactttagcacaaagtcaaactagagaatgtgttaaggagggaatgtatatgtcttggtagaccaggaggcctttgccagcaatttaagcaacagatgtgaatacttcacaaagctgtaaagaccattgtcttaaatactacaacaacttaacacccttttgtgaagatcacagcatttatctaagaaactgtgaggctttctggtttacatatatcttacaggtgtttttttgtatttttttttttttttagtttgaaatgtgtaagctttgatttaaaccaagtttacttcagtatgttaatgatgtagtaaaaatatttattgaaaggtgaattcgagtattttaatgttatacctgccattttttttcttaaagcatattctttgcatctaactgccagtgccattgtcaaaacttattttttaaatcgttgtacatttcttattaaactaagtgcttaattttaaagtattatgttgccatcatatagtgtataaaaatgtataattgccaattgattgtaactattatttatttttaaatgaaagtgtaagaatgctttctgattcaacaaatttgttatcaaactgtttccttatcctcttttctgatgtagcataaaaattgtcccggtttgagttataactgccagtagatgaccagtcacaagtgaaccacttctcagttgccaatctttgctcatattaaaaacaacttacaaatacttagtttttgtatctaatctctgattattaaaatgtttataaagtttatttttaccaaagagatgcaattcattatgagaaagtattgcataataaattttgttttataactttaaaaaaaaaaaatagaactagtc

SEQ ID NO: 33627 - DNA, 2282 bp, Homo sapiens
cttttaatttttattttggcaaaactgtcaaatgagaaaaatgattttaaaaacttttttttcaattgacaagactttaagtcagggataacagtattaatgttctctgttctgtttccatgttaaatttaatttaacctggatagccacattaatgaattggtgctgtcaaaatatagtaatttttaaatttgttaataatgaaaacccttaagcatgcaggatgaggtatttgggttttttttttagatcgatcacatctacagaaaatggctaaaccaagttaacttttattatagacagtgaataaaacaccaaaaacccaaaaatgctttaaccacagtataaataatagattatacacatcatcttaataactatttttaagttatttaccatagcctctgtatagaccttaggaacagtgtttcagtgatctggcaccagtttatttggttctgctgacaattctgtatcacaaatgtgctacctggtttttgtccattagataattactctttataaggaaaggaaagagaagcagagttagttccagctctaatagggatcttcaaagttattttgtcttgatgtatgtaacagtaattctttacatcttttgatttttctcttcctttttattcactcttcccacgaatttaaatgtttaagttatattcatcactagcaaggatgataaacacttgtgcactgaaagctaacagggagaggttacacaatattttacagtttcttaaacataatttaatgcatcaccttccacttgctaacataccaagtcagttattttcaagggaagaaccttttaaattatggtcctccatttactacttccactgagagtatgctctcattcctcaggtgttttgagaaacatgactaataaccacacaattaagtagagtcattccaagtcctatggcctggaaattgtattccctataatatacaaattttcctgtaataaagtcaacttagaaactccaaggaggttacatgttttccaacatatcctaaaaactgtgatataagctaacatataatttgccttacgtcaaaagaatatgttttgttgcagctgattccagtttataatagatccctagtaaaaagctttgattcaacacaattgttcatcttcacatcccaaacagaatcactgtttcttgaatatatatttttgaagtttttttgtgcaatatattactaaatcagttattattttacttttccaaattcagagaaagaaaacagattacctgaattcatggcagcatgacttcttttaacttggattcctttgtatatagtaaagtttagtatatatatatttttttctttttgctactttctgaggcattatgtaaagggctcatactagatgttcagttaaatatactttagcacaaagtcaaactagagaatgtgttaaggagggaatgtatatgtcttggtagaccaggaggcctttgccagcaatttaagcaacagatgtgaatacttcacaaagctgtaaagaccattgtcttaaatactacaacaacttaacacccttttgtgaagatcacagcatttatctaagaaactgtgaggctttctggtttacatatatcttacaggtgtttttttgtatttttttttttttttagtttgaaatgtgtaagctttgatttaaaccaagtttacttcagtatgttaatgatgtagtaaaaatatttattgaaaggtgaattcgagtattttaatgttatacctgccattttttttcttaaagcatattctttgcatctaactgccagtgccattgtcaaaacttattttttaaatcgttgtacatttcttattaaactaagtgcttaattttaaagtattatgttgccatcatatagtgtataaaaatgtataattgccaattgattgtaactattatttatttttaaatgaaagtgtaagaatgctttctgattcaacaaatttgttatcaaactgtttccttatcctcttttctgatgtagcataaaaattgtcccggtttgagttataactgccagtagatgaccagtcacaagtgaaccacttctcagttgccaatctttgctcatattaaaaacaacttacaaatacttagtttttgtatctaatctctgattattaaaatgtttataaagtttatttttaccaaagagatgcaattcattatgagaaagtattgcataataaattttgttttataactttaaaaaaaaaaaatagaactagtc

SEQ ID NO: 33628 - DNA, 1028 bp, Homo sapiens
acagatctagaaggatcccctctcagggacattaagtccagcatgacttcttttaacttggattcctttgtatatagtaaagtttagtatatatatatttttttctttttgctactttctgaggcattatgtaaagggctcatactagatgttcagttaaatatactttagcacaaagtcaaactagagaatgtgttaaggagggaatgtatatgtcttggtagaccaggaggcctttgccagcaatttaagcaacagatgtgaatacttcacaaagctgtaaagaccattgtcttaaatactacaacaacttaacacccttttgtgaagatcacagcatttatctaagaaactgtgaggctttctggtttacatatatcttacaggtgtttttttgtatttttttttttttttagtttgaaatgtgtaagctttgatttaaaccaagtttacttcagtatgttaatgatgtagtaaaaatatttattgaaaggtgaattcgagtattttaatgttatacctgccattttttttcttaaagcatattctttgcatctaactgccagtgccattgtcaaaacttattttttaaatcgttgtacatttcttattaaactaagtgcttaattttaaagtattatgttgccatcatatagtgtataaaaatgtataattgccaattgattgtaactattatttatttttaaatgaaagtgtaagaatgctttctgattcaacaaatttgttatcaaactgtttccttatcctcttttctgatgtagcataaaaattgtcccggtttgagttataactgccagtagatgaccagtcacaagtgaaccacttctcagttgccaatctttgctcatattaaaaacaacttacaaatacttagtttttgtatctaatctctgattattaaaatgtttataaagtttatttttaccaaagagatgcaattcattatgagaaagtattgcataataaattttgttttataactttaaaaaaaaaaaatagaactagtc

SEQ ID NO: 33629 - DNA, 307 bp, Homo sapiens
ctgaagcctggtggcccagaagcccaggtagaaggggccaagtttgtgttgaggaggaaaatgggtagttcctggcgactgactgcagctgcagaagggaaagaactggagtctccccaggagcgtgactgtgacccgctcctctcaattcaatgcttgggtgagcatctgtgacaggccaggcttgtcccatgtgcaagggacagccatgaacgggccagatgaggaatctcacagagctcccagcctgtgagggacaagcgggtgttaaacacatcgcaaagagagtgatgacttacgaattctt

SEQ ID NO: 33630 - DNA, 937 bp, Homo sapiens
taaagtccgtaagaggaaggtgactacgtatatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgat

SEQ ID NO: 33631 - DNA, 397 bp, Homo sapiens
ccaacaaacaaaaatgtataaatgacaaaaaattaaatctgctctttagaacttgataattcatgagaaaatgaaaatagtttccatcatcctttctcaggctgctgttttttatttgtctaagaagaaaagaaaatatgtcaaagcctatggtagtcactagggctgttcactgatgggcccacttatttatctccagccaatgggaggattgaacttccctggtaccttgaagtttgtgtggtcatatgacttgttctggccaatgagtgtgagtggaagtgatgaaacgtcagttcttaccagaaaatttaaatcgacattaggagaccctccataaccctcttttttttctccacagcatgttgatcctggatcaacatgctgtgggagagaa

SEQ ID NO: 33632 - DNA, 308 bp, Homo sapiens
cttctgcattatcaggtaaccacaggtaattcataaatattatccgtggaatttacttacttaatatctgtatgagtctttatattggcatgtgaggtttttcatagttcagtaaaagcttgactcagtcagagggatcacagaattacatgtttctttttcacccaccaacattttgttgaaaatcttgttaaagtgcattctttcttttttttgatgtactatatggaatgtaagaccattttttaaggtaataattggtagtgttaatatagtaacatagataaaatacaagggaatttgattta

SEQ ID NO: 33633 - DNA, 328 bp, Homo sapiens
taaaataacatgctataattgccagcgtgaagcaaagagtgcggtagcaataccagcctcagtatgaggcataaaattattctaaagttactagacaattatgttacaattattaataacagcttaatatttggaaatgttaagcaattatcccctgatttcttctttacctgttgacttttctcccaaatatgtcagttattctccaagatattcattgccactagaaagagggattatggtaagcgagcagttaaaacaataacaacaacaagaaagaaaaaccttgaatttccaaagtttagttcacaatattactcagtacaaa

SEQ ID NO: 33634 - DNA, 301 bp, Homo sapiens
ttatggctctttaaagatctagaagaccatcaactttatttgaatcatatgtcaaacacacacacacacacacacacacaaacacacacacacacacacccctacaaaacaatctgagaaatctgaacattgactggatatttgacagccttaggaatgattattaaagatgtgatcatagaattgtgattacatttttattcaacaggtttttggggaacaggtggtgtttggtgatgttaataagttatttattggtgatttctgagattttaatgcttccatcacccgagcagtgtac

SEQ ID NO: 33635 - DNA, 417 bp, Homo sapiens
gtttggtggagatggttgcttggtgtctcccctctgactctttcccttctccttctccatgggtaaattattcttccaaattctccctgtgttcaccattataactgttttctgctgcaatctttttctggaaagttccccccttcctacctcctgcccattcctcccaatcagttcagctcttgtgtgtgctggacagaaatccctcttggcagcctaggcaacatagcaagacccccaactctatatatttttttaaattagccagcatgataatgcacacctatagtcttatctactctggaggctgaggtgggaggatcacttgagcccagaagttaaaggctgcagtgagctatgatggcaccactgcattctagcctgggtgacggagcaagaccctgtctcaaaacaagc

SEQ ID NO: 33636 - DNA, 367 bp, Homo sapiens
tgtggaaattgacaactcattagccagtttatcatcaaaatcctcattgaaatgatcttcattaccactagtattttatttcaaatcagcaagaagatatttaaatatttttcgaatatgttcatgcgatttactcttcttcattagctagattattagacaatccaaagtctgcttattctctttcaaatgtatcatctcatcttaatgagttaattttggtatgatttgaaaatgtttttgttataatttgcttattgacagaataacttttatccattttatataggagttaattgggaaagttattttatgatgagtttgtaattgtatactctgaattattaaatatattcttaacaggcaa

SEQ ID NO: 33637 - DNA, 392 bp, Homo sapiens
gccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgaggtaactctt

SEQ ID NO: 33638 - DNA, 937 bp, Homo sapiens
agtaaacaaatttttttaggggatcaggaaaagaaatagtgaacttgacaatggcattctttagttttcagtttggaatttaattggaaactcatttagattttaataaaaagggaataaatatatatcttgtatcatgtggatgccttaggctgtcagtaacagaacactccagtgaagaaaagatctcccagaacaagaagtccagaggaagggagagaaggaagacaggttcggggttggttaatttagtggctcactgatctaatcaaggaccccgacactttgcatctttatactctgccattctcagaatcttctctcatgattgtactctggctgtattgaatgcagactcaacagtgtcttatgaagaaatggaatatttcctcctgtacatctctttttgttagcaagacaacaatttcatggaaaccctccagtttttccctcaggtcctattgattaggattggggtcacttgcctttcttaaaccatctggcaaggggaatgagaccattatgattggcttgaaccaattaggagtcactctcctgggattggggagggccctgcctctaagtagttagctgcctgataattctgcaaaagctggcttctattagcaagggaggaggaggggaatgatgtagaataatgactattgtcaggccacagcatggggcattttacttacatttaaacataaggtaatacttagtttctgctacagaatttctaatacatgtacttaagagttttgctggctgggaacagtggctcatgcctgtggtcccagtgctttcagaggctgaggcaggaggatcgcttaagcccagcctcagacttctgtttgaggctgcagtgagctatgatagtaccactgcgtgccagcctgggcaacagagcaagaccctgtctcaaaattaaaaaaaa

SEQ ID NO: 33639 - DNA, 1366 bp, Homo sapiens
ctccccgctaagtgcgcaggctcctggaaagttgtcttcacttccgggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaaaggcctgaagattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactgagccttttagtttcgaacactttt

SEQ ID NO: 33640 - DNA, 625 bp, Homo sapiens
ataggcactgaatatatgttgactgaatgactatgaggaaaaacaagtattattaacattagctcatttcggtaaacctagcctaacacttaaaatatttctcataatattctaattgctcttattgtctacttattgccagaagttaaaatgcattttgctaatcagtcaatagaacctttgggaagaaaagtggaaaggtctgaaacttcctccctcccacaaaaaggcctgaagattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactgagccttttagtttcgaacactttt

SEQ ID NO: 33641 - DNA, 993 bp, Homo sapiens
ctccccgctaagtgcgcaggctcctggaaagttgtcttcacttccgggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacaggtgcctacagaacatataacagaagtattttattgctgttatctcttattaagtttacacctagatcttactattaaaatttatacttatgtggaactacataattttaagtacaatgtaaatattgaccaataatattaatttgtcattacaaaaaaaaaagggggggggtaaagttcctgagggcaagtttgggtccagttttgtaaaggc

SEQ ID NO: 33642 - DNA, 1258 bp, Homo sapiens
ctccccgctaagtgcgcaggctcctggaaagttgtcttcacttccgggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtaaaatgttgaagttagaaatctaagtactaaatgcatttttttttacagttttgactattctaatatggtcttaaatgtagctgtctcatgtacatttatttcaagtttgaaagacttcagctgacttgagattttagagtatatggctgggtgcagtggctcacgccttggcctcccaacgtggccggaagcagtggttcttaagctttagcaagcattggaaatggttggagggcttgctgaagcacatatggctgcctcccagtttctgatttaataggtctggggtaccgataatttgcatttttaacaatgatatggtttggctgtgtccccacccaaatctcatcttgaattcccacgtgttgtgggagggacccagtgggaggtaattgaattttgggggcaggtgttccccatgctgttcttgtgatagtgaataagtctcatgagatctgatggttttgggaaaggggagtcttcctgcacaagctctctctttgcctgctgtcatccatgtaagacgtgattgctcctgtttgtcttccgccatgattgtgaggcttccccagccatgtggaaatgtaagtccgattaaacctctttcctgtgtaa

SEQ ID NO: 33643 - DNA, 956 bp, Homo sapiens
ctccccgctaagtgcgcaggctcctggaaagttgtcttcacttccgggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggtttttgctttgtgttattctgctaacatacagttttaacaaatgcccagggttaaacactcacttaaatttgaatgtttgattgacaaagtgtaatattttagacattgtgagaggtagaaagataattcatcacatatgagttctttttgagagcaaccctgaaaaatgataatttgaggcattaatgaactgatgcaactcaaagtgacctttctaaactcagaactagaataagatcacagggtttatacaaactactgttttatttacatagatctccaataattctgcagttgctccttttataattttagcagatccacagtcagtagttcctgctgctgcttccttctcttggaactacttgtattatcttactggttgtgtagtgctaggctgaagtagtaatacatatgttataaactaat

SEQ ID NO: 33644 - DNA, 467 bp, Homo sapiens
gtctgtttcacctgggcattctgaaatgttttatcatagagcagcatcagtaccacctttatcatagagcacatcagccaccacttcccagaggggttctccaagaagagactttacgaagaagagatttaggaaacctagtctatgtctgtctctccctccgtcccacaagaaggtgcccccgatttttgttcatttgaggcagtatgttgggaattttagacaaattaccctatttcatactgtagccaattttttctttttttttcaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactgagccttttagtttcgaacactttt

SEQ ID NO: 33645 - DNA, 681 bp, Homo sapiens
ataggcactgaatatatgttgactgaatgactatgaggaaaaacaagtattattaacattagctcatttcggtaaacctagcctaacacttaaaatatttctcataatattctaattgctcttattgtctacttattgccagaagttaaaatgcattttgctaatcagtcaatagaacctttgggaagaaaagtggaaaggtctgaaacttcctccctcccacaaaaaggcctgaagattcctggcttagagcatgcgagcattgaaggaccaatagcagtaagtaaacgacatcacttaagaactataagcaaaatgacaaggtactgggaaatcaaacttcgaattgaatcactcagtgggcatctgtgctacttactaaatggatttgaatttagatagctccttttcttacttgacccagaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggtatggctagccttaatatgtcaagatttacaaatctggtggtggaactatcaaaatcagaatatgtgcaagaaagcctctaataaattttgcttgcagacccattc

SEQ ID NO: 33646 - DNA, 1196 bp, Homo sapiens
accacggcccataacctctttaatggcttggcagcaggacctttcctttgattgtttcttgaagatatgagatctatagttcagttgtatcgttggctcttaagggcctggaacatgcaacaatagggcttccgttgttgcatggcaaacatgagaattttgcatggcccttactggggagtttcctcctcatttgactgatgtgagtagagactcttagagccagccaccatcataatcatctactagaatcccaagatgctttccccagcagctaatagcgctgttgtctgtgggtagggggaaaacaccaccctaaccctgaagaatccatgacatagtgctattactttgatgtgaataagtctggaaaatagtctctttctactgtggtttgctctataaaatccttgcctctgaattttcctgaaaactatgctttattctgacttacgggttagacaattttagtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaaaggcctgaagattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactgagccttttagtttcgaacactttt

SEQ ID NO: 33647 - DNA, 1511 bp, Homo sapiens
ctccccgctaagtgcgcaggctcctggaaagttgtcttcacttccgggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaaaggcctgaagattcctggcttagagcatgcgagcattgaaggaccaatagcagtaagtaaacgacatcacttaagaactataagcaaaatgacaaggtactgggaaatcaaacttcgaattgaatcactcagtgggcatctgtgctacttactaaatggatttgaatttagatagctccttttcttacttgacccagaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactgagccttttagtttcgaacactttt

SEQ ID NO: 33648 - DNA, 441 bp, Homo sapiens
ttctagaggatcccgtgcaccgtacttcctccctcccacaaaaaggcctgaagattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactgagccttttagtttcgaacactttt

SEQ ID NO: 33649 - DNA, 1068 bp, Homo sapiens
ctccccgctaagtgcgcaggctcctggaaagttgtcttcacttccgggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacaggtgcctacagaacatataacagaagtattttattgctgttatctcttattaagtttacacctagatcttactattaaaatttatacttatgtggaactacataattttaagtacaatgtaaatattgaccaataatattaatatatcaataattctatgtatgtcgtgcattactgctggccaccatattatatagtactatatatacttaactgtatatagtacaaacaccacatagtactaattaatcttacaggacatgcatataagcaagagtagtcatttttt

SEQ ID NO: 33650 - DNA, 851 bp, Homo sapiens
ctccccgctaagtgcgcaggctcctggaaagttgtcttcacttccgggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttaggtaccattctttaattgttttttaaatgaatcattattaatattatatgatctgtacatatgctttttgcccaacaaatatgaactaataaaattgctaaattctctactgaaaaccatcaaa

SEQ ID NO: 33651 - DNA, 643 bp, Homo sapiens
ctccccgctaagtgcgcaggctcctggaaagttgtcttcacttccgggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaacaaacattactaaagaggagattgcttgcagagaaactcaaagaagaagttattaataagtaataattaagaacaatttaacaaaatggaagttcaaattgtcttaaaaataaattatttagtccttacactgagccttttagtttcgaacactttt

SEQ ID NO: 33652 - DNA, 668 bp, Homo sapiens
tgagacggagtctcgctctgttgctcaggctggagtgcagtggcatgatctcggcttactgcatgctctgccttgcgggtttacaccattctcctgcctcagccttctgagtagctgggactacaggcacctgccaccactccgggctaattttttgtatttttagtagagatggggtttcaccatgttagccaggatggtctcgatctcctgacctcgtgatccgcccgccttggcctcccaacgtggccggaagcagtggttcttaagctttagcaagcattggaaatggttggagggcttgctgaagcacatatggctgcctcccagtttctgatttaataggtctggggtaccgataatttgcatttttaacaatgatatggtttggctgtgtccccacccaaatctcatcttgaattcccacgtgttgtgggagggacccagtgggaggtaattgaattttgggggcaggtgttccccatgctgttcttgtgatagtgaataagtctcatgagatctgatggttttgggaaaggggagtcttcctgcacaagctctctctttgcctgctgtcatccatgtaagacgtgattgctcctgtttgtcttccgccatgattgtgaggcttccccagccatgtggaaatgtaagtccgattaaacctc

SEQ ID NO: 33653 - DNA, 662 bp, Homo sapiens
taatttagtggctcactgatctaatcaaggaccccgacactttgcatctttatactctgccattctcagaatcttctctcatgattgtactctggctgtattgaatgcagactcaacagtgtcttatgaagaaatggaatatttcctcctgtacatctctttttgttagcaagacaacaatttcatggaaaccctccagtttttccctcaggtcctattgattaggattggggtcacttgcctttcttaaaccatctggcaaggggaatgagaccattatgattggcttgaaccaattaggagtcactctcctgggattggggagggccctgcctctaagtagttagctgcctgataattctgcaaaagctggcttctattagcaagggaggaggaggggaatgatgtagaataatgactattgtcaggccacagcatggggcattttacttacatttaaacataaggtaatacttagtttctgctacagaatttctaatacatgtacttaagagttttgctggctgggaacagtggctcatgcctgtggtcccagtgctttcagaggctgaggcaggaggatcgcttaagcccagcctcagacttctgtttgaggctgcagtgagctatgatagtaccactgcgtgccagcctgggcaaca

SEQ ID NO: 33654 - DNA, 1675 bp, Homo sapiens
taactagtaaggcggggttaatggacgaggggggcgttgcggccgcaggtttgactcccgtgcggtgcggcccagcagccacaaagctcccgctgccattgctccctgtactcccgccgtcactgccgctgtccaacccctcccccggggcttgcgcggcggctcccacacccctcggcccgtgtacgcgctctgcacctgcctgcccgaaaacatgttgcagacaccagagagcagggggctcccggtcccgcaggccgagggggagaaggatggcggccatgatggtgagacccgggccccgaccgcctcgcaggagcgccccaaggaggagcttggcgccgggagggaggagggggctgcggagcccgccctcacccggaaaggcgcgagggccttggcggccaaatccttggcaaggcgcagggcctaccgccggctgaatcggacggtggcggagttggtgcagttcctcctggtgaaagacaagaagaagagtcccatcacacgctcggagatggtgaaatacgttattggagacttgaagattctgttcccggacatcatcgcaagggccgcagagcatctgcggtatgtctttggttttgagctgaaacagtttgaccgcaagcaccacacttacatcctgatcaacaaactaaaacctctggaggaggaggaggaggaggaggatctgggaggagatggccccagattgggtctgttaatgatgatcctgggccttatctatatgagaggtaatagcgccagggaggcccaggtctgggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtggagca

SEQ ID NO: 33655 - DNA, 1706 bp, Homo sapiens
ccggaagtggcccctcgcgcgggcgcggactgaggctgcgcgccgcaggttccggctgctggcggcgttgcggccgcaggtttgactcccgtgcggtgcggcccagcagccacaaagctcccgctgccattgctccctgtactcccgccgtcactgccgctgtccaacccctcccccggggcttgcgcggcggctcccacacccctcggcccgtgtacgcgctctgcacctgcctgcccgaaaacatgttgcagacaccagagagcagggggctcccggtcccgcaggccgagggggagaaggatggcggccatgatggtgagacccgggccccgaccgcctcgcaggagcgccccaaggaggagcttggcgccgggagggaggagggggctgcggagcccgccctcacccggaaaggcgcgagggccttggcggccaaatccttggcaaggcgcagggcctaccgccggctgaatcggacggtggcggagttggtgcagttcctcctggtgaaagacaagaagaagagtcccatcacacgctcggagatggtgaaatacgttattggagacttgaagattctgttcccggacatcatcgcaagggccgcagagcatctgcggtatgtctttggttttgagctgaaacagtttgaccgcaagcaccacacttacatcctgatcaacaaactaaaacctctggaggaggaggaggaggaggaggatctgggaggagatggccccagattgggtctgttaatgatgatcctgggccttatctatatgagaggtaatagcgccagggaggcccaggtctgggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtggagca

SEQ ID NO: 33656 - DNA, 2690 bp, Homo sapiens
ccggaagtggcccctcgcgcgggcgcggactgaggctgcgcgccgcaggttccggctgctggcggcgttgcggccgcaggtttgactcccgtgcggtgcggcccagcagccacaaagctcccgctgccattgctccctgtactcccgccgtcactgccgctgtccaacccctcccccggggcttgcgcggcggctcccacacccctcggcccgtgtacgcgctctgcacctgcctgcccgaaaacatgttgcagacaccagagagcagggggctcccggtcccgcaggccgagggggagaaggatggcggccatgatggtgagacccgggccccgaccgcctcgcaggagcgccccaaggaggagcttggcgccgggagggaggagggggctgcggagcccgccctcacccggaaaggcgcgagggccttggcggccaaatccttggcaaggcgcagggcctaccgccggctgaatcggacggtggcggagttggtgcagttcctcctggtgaaagacaagaagaagagtcccatcacacgctcggagatggtgaaatacgttattggagacttgaagattctgttcccggacatcatcgcaagggccgcagagcatctgcggtatgtctttggttttgagctgaaacagtttgaccgcaagcaccacacttacatcctgatcaacaaactaaaacctctggaggaggaggaggaggaggaggatctgggaggagatggccccagattgggtctgttaatgatgatcctgggccttatctatatgagaggtaatagcgccagggaggcccaggtctgggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtggagcaaaaaaaaaaaaaaaaaaaaaaaaaaaaaaaaaaaaaaaaaaaaaaaaaaaaaaaaaaaaaaaaaaaaaaaaagaagaagagaaagaaaagaaaaagaacgacagaaggaacacggaaacaaaaagaagaacacacaacgacgtcaatcaccaaacacagacggaccaccaacacagaccgacgacacaatacacgaaggcagagcccgaaccgtcagaacacaaacgccgccgcccgacgcacacacaggcaacgcaaccacgccgtcgcagagacagcgcccgtacagcggagcacaaccagggacggaagacaacaccagcaaacagcaagacagagacacacttgaaagagctacaaaacaagcacgacagcacgatccaggcggagcaacaacacatagagccgtagtcagcggcaggaaagtacacaatgagcggactcaagacaatgagaaaccctagaagagcaacagtactcaatacagcagaacgaatatgtcataacgatacgccgatcaaaaaagataatgtgcaagtccagacggtgcacacgtaacacaagacgcgcaaacaagccttgacagcgaaagtggaagagaaggggaagaggaggagaggaggagagggagaggcgtgaagtggagggagttacgttgcagatgccatgaggagggcatgaatcgcgttgagagatggctggtagagagagttgctgatggagatggtgtgtgttggtcgagccataggggaggagagcaggcgaggtgagaagagacgtgcgcaggcgtgaagcgggttgcgttgagtgcggggagagagataaggaaaggattcggagcgaagtagaggaggaaagcggaggagtggagtgcggtacatagcctggtgagcagctggagatcagcggtgagcttgatgatggatagatgggagcgaggaaggagggagttggagagggtatggtgagtgcagcgagcatggg

SEQ ID NO: 33657 - DNA, 1610 bp, Homo sapiens
aagattggctaggtcgaggctgggtggctgccattgctccctgtactcccgccgtcactgccgctgtccaacccctcccccggggcttgcgcggcggctcccacacccctcggcccgtgtacgcgctctgcacctgcctgcccgaaaacatgttgcagacaccagagagcagggggctcccggtcccgcaggccgagggggagaaggatggcggccatgatggtgagacccgggccccgaccgcctcgcaggagcgccccaaggaggagcttggcgccgggagggaggagggggctgcggagcccgccctcacccggaaaggcgcgagggccttggcggccaaatccttggcaaggcgcagggcctaccgccggctgaatcggacggtggcggagttggtgcagttcctcctggtgaaagacaagaagaagagtcccatcacacgctcggagatggtgaaatacgttattggagacttgaagattctgttcccggacatcatcgcaagggccgcagagcatctgcggtatgtctttggttttgagctgaaacagtttgaccgcaagcaccacacttacatcctgatcaacaaactaaaacctctggaggaggaggaggaggaggaggatctgggaggagatggccccagattgggtctgttaatgatgatcctgggccttatctatatgagaggtaatagcgccagggaggcccaggtctgggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtggagca

SEQ ID NO: 33658 - DNA, 1626 bp, Homo sapiens
aacaagctcaagtacgaggccgggtgttcaatcgagagcgagggcgccattgctccctgtactcccgccgtcactgccgctgtccaacccctcccccggggcttgcgcggcggctcccacacccctcggcccgtgtacgcgctctgcacctgcctgcccgaaaacatgttgcagacaccagagagcagggggctcccggtcccgcaggccgagggggagaaggatggcggccatgatggtgagacccgggccccgaccgcctcgcaggagcgccccaaggaggagcttggcgccgggagggaggagggggctgcggagcccgccctcacccggaaaggcgcgagggccttggcggccaaatccttggcaaggcgcagggcctaccgccggctgaatcggacggtggcggagttggtgcagttcctcctggtgaaagacaagaagaagagtcccatcacacgctcggagatggtgaaatacgttattggagacttgaagattctgttcccggacatcatcgcaagggccgcagagcatctgcggtatgtctttggttttgagctgaaacagtttgaccgcaagcaccacacttacatcctgatcaacaaactaaaacctctggaggaggaggaggaggaggaggatctgggaggagatggccccagattgggtctgttaatgatgatcctgggccttatctatatgagaggtaatagcgccagggaggcccaggtctgggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtggagca

SEQ ID NO: 33659 - DNA, 1440 bp, Homo sapiens
taactagtaaggcggggttaatggacgaggggggcgttgcggccgcaggtttgactcccgtgcggtgcggcccagcagccacaaagctcccgctgccattgctccctgtactcccgccgtcactgccgctgtccaacccctccccggaaaggcgcgagggccttggcggccaaatccttggcaaggcgcagggcctaccgccggctgaatcggacggtggcggagttggtgcagttcctcctggtgaaagacaagaagaagagtcccatcacacgctcggagatggtgaaatacgttattggagacttgaagattctgttcccggacatcatcgcaagggccgcagagcatctgcggtatgtctttggttttgagctgaaacagtttgaccgcaagcaccacacttacatcctgatcaacaaactaaaacctctggaggaggaggaggaggaggaggatctgggaggagatggccccagattgggtctgttaatgatgatcctgggccttatctatatgagaggtaatagcgccagggaggcccaggtctgggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtggagca

SEQ ID NO: 33660 - DNA, 1620 bp, Homo sapiens
ccggaagtggcccctcgcgcgggcgcggactgaggctgcgcgccgcaggttccggctgctggcggcgttgcggccgcaggtttgactcccgtgcggtgcggcccagcagccacaaagctcccgctgccattgctccctgtactcccgccgtcactgccgctgtccaacccctcccccggggcttgcgcggcggctcccacacccctcggcccgtgtacgcgctctgcacctgcctgcccgaaaacatgttgcagacaccagagagcagggggctcccggtcccgcaggccgagggggagaaggatggcggccatgatggtgagacccgggccccgaccgcctcgcaggagcgccccaaggaggagcttggcgccgggagggaggagggggctgcggagcccgccctcacccggaaaggcgcgagggccttggcggccaaatccttggcaaggcgcagggcctaccgccggctgaatcggacggtggcggagttggtgcagttcctcctggtgaaagacaagaagaagagtcccatcacacgctcggagatggtgaaatacgttattggagacttgaagattctgttcccggacatcatcgcaagggccgcagagcatctgcggtatgtctttggttttgagctgaaacagtttgaccgcaagcaccacacttacatcctgatcaacaaactaaaacctctggaggaggaggaggaggaggaggatctgggaggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtggagca

SEQ ID NO: 33661 - DNA, 1220 bp, Homo sapiens
ttctgttcccggacatcatcttcaagtctccaataacgtatttcaccatctccgagcgtgtgatggtgaaatacgttattggagacttgaagattctgttcccggacatcatcgcaagggccgcagagcatctgcggtatgtctttggttttgagctgaaacagtttgaccgcaagcaccacacttacatcctgatcaacaaactaaaacctctggaggaggaggaggaggaggaggatctgggaggagatggccccagattgggtctgttaatgatgatcctgggccttatctatatgagaggtaatagcgccagggaggcccaggtctgggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtggagca

SEQ ID NO: 33662 - DNA, 1061 bp, Homo sapiens
  misc_feature (43)..(43): n is a, c, g, or t
gccggaccttcaaagcggagatgctgattggactggtgtgccnagctggcggtataggctgaaggcgaactcagccaggttgggggcgatcttgttgaaggttgggtgatcctgatcatggtgggatgtatctgtcttctgggcagcatctccgctttggaaattccaaagcggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtggagca

SEQ ID NO: 33663 - DNA, 2895 bp, Homo sapiens
gccagaaatcttcccagtagagatcaccatccgcccccgacccccaagaatacttaaggggtgggtccttcccatcaagctgatttctcaacgagagggacaatcccagcttccccaacattgcagagcccaaacatgtggaagagttggaagctccgcacagatgtcagagtaagggagggggcaggcggttctccttgtgcctcttcccagcccggtagcaggggcccatgcttcctccctggtctgtcctcgcaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcggtgggtgacccatcaagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgca

SEQ ID NO: 33664 - DNA, 3057 bp, Homo sapiens
ctgcccctccccgcccttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcggtgggtgacccatcaagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactgagctgctgcagtttcacagggaaggctgcacctatcaatcaatcaatcaatcctatcccaagacacagttccctgagggaagaagaggagggacctggaaaggcctaagggtgtactctctgtatagccccgctatgggaaaataaagtggagtagggggcatag

SEQ ID NO: 33665 - DNA, 3450 bp, Homo sapiens
ctgcccctccccgcccttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcggtgggtgacccatcaagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactgagctgctgcagtttcacagggaaggctgcacctatcaatcaatcaatcaatcctatcccaagacacagttccctgagggaagaagaggagggacctggaaaggcctaagggtgtactctctgtatagccccgctatgggaaaataaagtggagtagggggcatagaaatgcaccatctaagggaaatcttttgtcaggtggtggccaggggtgttcaaagctcattgcttgcattaccagctattagagagatcagagagggcaattaattagaggctcctggttctcacatcccaaacacacacagttctggcctgctgggctctctaacttggatgtctttgagtcctcagtggtgccccctgcctgcctcccctttgccctatgccaaggtgtgctggcaaatattaaacaaccagctctctggaaaagacaatttgtgatataaatactcccatgttgaataatttcaagctaccagtatgtcaaatggcttgcaaaatttctgaaaatgtaaacaattggttctcacagagctggtacaagctggctccagca

SEQ ID NO: 33666 - DNA, 2792 bp, Homo sapiens
ctgcccctccccgcccttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcagagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgca

SEQ ID NO: 33667 - DNA, 2728 bp, Homo sapiens
ctgcccctccccgcccttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcggtgggtgacccatcaagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgca

SEQ ID NO: 33668 - DNA, 2767 bp, Homo sapiens
tccaatttcacctggctcctggggctgtcacttccctttgcttcatgtttataaaatgagaggactgggccagcccatcataagatgggggagggcacagaaacttgtcttgaggagactctaaggggaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcggtgggtgacccatcaagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgca
